US011492639B2

(12) United States Patent
Abad et al.

(10) Patent No.: US 11,492,639 B2
(45) Date of Patent: Nov. 8, 2022

(54) INSECTICIDAL POLYPEPTIDES AND USES THEREOF

(71) Applicant: PIONEER HI-BRED INTERNATIONAL, INC., Johnston, IA (US)

(72) Inventors: Andre R Abad, Leander, TX (US); Hua Dong, Johnston, IA (US); Sue B Lo, West Des Moines, IA (US); Brad Poland, Monroe, IA (US); Xiaomei Shi, Johnston, IA (US); Jimei Wang, Johnston, IA (US); Thomas Chad Wolfe, Des Moines, IA (US); Lan Zhou, Ankeny, IA (US)

(73) Assignee: PIONEER HI-BRED INTERNATIONAL, INC.

( * ) Notice: Subject to any disclaimer, the term of this patent is extended or adjusted under 35 U.S.C. 154(b) by 0 days.

(21) Appl. No.: 16/771,816

(22) PCT Filed: Nov. 14, 2018

(86) PCT No.: PCT/US2018/060878
§ 371 (c)(1),
(2) Date: Jun. 11, 2020

(87) PCT Pub. No.: WO2019/125651
PCT Pub. Date: Jun. 27, 2019

(65) Prior Publication Data

US 2021/0198686 A1 Jul. 1, 2021

Related U.S. Application Data

(60) Provisional application No. 62/607,372, filed on Dec. 19, 2017.

(51) Int. Cl.
*C12N 15/82* (2006.01)
*C07K 14/325* (2006.01)

(52) U.S. Cl.
CPC ........ *C12N 15/8286* (2013.01); *C07K 14/325* (2013.01)

(58) Field of Classification Search
None
See application file for complete search history.

(56) References Cited

U.S. PATENT DOCUMENTS

| | | | |
|---|---|---|---|
| 8,575,433 | B2 | 11/2013 | Cerf et al. |
| 2007/0118924 | A1 | 5/2007 | Payne et al. |

FOREIGN PATENT DOCUMENTS

| | | | | |
|---|---|---|---|---|
| WO | 1997/013402 A1 | 4/1997 | | |
| WO | 1998/015170 A1 | 4/1998 | | |
| WO | WO-2013134734 A2 * | 9/2013 | ............. | A01N 63/50 |
| WO | 2016/061208 A1 | 4/2016 | | |
| WO | 2016/061391 A2 | 4/2016 | | |
| WO | 2017/007679 A1 | 1/2017 | | |
| WO | 2017/035364 A1 | 3/2017 | | |
| WO | 2017/132188 A1 | 8/2017 | | |
| WO | 2017/146899 A1 | 8/2017 | | |
| WO | 2017/192560 A1 | 11/2017 | | |

OTHER PUBLICATIONS

NCBI Reference Sequence: WP_098389584.1. First available online on Oct. 19, 2017 (Year: 2017).*
International Search Report and Written Opinion for International Applicat No. PCT/US2018/060878, dated Mar. 8, 2019.
EPO Partial Search of EP Application No. 18892988 9 (International Application No. PCT/US2018/060878), dated Aug. 27, 2021.
Lucena, Wagner A.; et al.: "Molecular Approaches to Improve the Insecticidal Activity of *Bacillus thuringiensis* Cry Toxins," Toxings, 2014, vol. 6, pp. 2393-2423.

* cited by examiner

*Primary Examiner* — Matthew R Keogh

(57) ABSTRACT

The disclosure provides nucleic acids, and variants and fragments thereof, obtained from strains of *Bacillus thuringiensis* encoding polypeptides having pesticidal activity against insect pests, including Lepidopteran and Coleopteran. Particular embodiments of the disclosure provide isolated nucleic acids encoding pesticidal proteins, pesticidal compositions, DNA constructs, and transformed microorganisms and plants comprising a nucleic acid of the embodiments. These compositions find use in methods for controlling pests, especially plant pests.

13 Claims, No Drawings

Specification includes a Sequence Listing.

INSECTICIDAL POLYPEPTIDES AND USES THEREOF

CROSS REFERENCE

This application claims the benefit of PCT Application No. PCT/US18/60878 filed on Nov. 14, 2018, which claims the benefit of U.S. Provisional Application No. 62/607,372 filed Dec. 19, 2017, the disclosures of each of which is incorporated herein by reference in its entirety.

REFERENCE TO SEQUENCE LISTING SUBMITTED ELECTRONICALLY

A sequence listing having the file name "7492 USPCT_sequencelisting.txt" created on Jun. 8, 2020 and having a size of 1,073 kilobytes is filed in computer readable form concurrently with the specification. The sequence listing is part of the specification and is herein incorporated by reference in its entirety.

FIELD

The present disclosure relates to naturally-occurring and recombinant nucleic acids obtained from novel *Bacillus thuringiensis* genes that encode pesticidal polypeptides characterized by pesticidal activity against insect pests. Compositions and methods of the disclosure utilize the disclosed nucleic acids, and their encoded pesticidal polypeptides, to control plant pests.

BACKGROUND

Insect pests are a major factor in the loss of the world's agricultural crops. For example, armyworm feeding, black cutworm damage, or European corn borer damage can be economically devastating to agricultural producers. Insect pest-related crop loss from European corn borer attacks on field and sweet corn alone has reached about one billion dollars a year in damage and control expenses.

Traditionally, the primary method for impacting insect pest populations is the application of broad-spectrum chemical insecticides. However, consumers and government regulators alike are becoming increasingly concerned with the environmental hazards associated with the production and use of synthetic chemical pesticides. Because of such concerns, regulators have banned or limited the use of some of the more hazardous pesticides. Thus, there is substantial interest in developing alternative pesticides.

Biological control of insect pests of agricultural significance using a microbial agent, such as fungi, bacteria, or another species of insect affords an environmentally friendly and commercially attractive alternative to synthetic chemical pesticides. Generally speaking, the use of biopesticides presents a lower risk of pollution and environmental hazards, and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a broad range of insect pests including *Lepidoptera, Diptera, Coleoptera, Hemiptera*, and others. *Bacillus thuringiensis* (Bt) and *Bacillus papilliae* are among the most successful biocontrol agents discovered to date. Insect pathogenicity has also been attributed to strains of *B. larvae, B. lentimorbus, B. sphaericus* (Harwook, ed., ((1989) *Bacillus* (Plenum Press), 306) and *B. cereus* (WO 96/10083). Pesticidal activity appears to be concentrated in parasporal crystalline protein inclusions, although pesticidal proteins have also been isolated from the vegetative growth stage of *Bacillus*. Several genes encoding these pesticidal proteins have been isolated and characterized (see, for example, U.S. Pat. Nos. 5,366,892 and 5,840,868).

Microbial insecticides, particularly those obtained from *Bacillus* strains, have played an important role in agriculture as alternatives to chemical pest control. Recently, agricultural scientists have developed crop plants with enhanced insect resistance by genetically engineering crop plants to produce pesticidal proteins from *Bacillus*. For example, corn and cotton plants have been genetically engineered to produce pesticidal proteins isolated from strains of Bt (see, e.g., Aronson (2002) *Cell Mol. Life Sci.* 59(3):417-425; Schnepf et al. (1998) *Microbiol Mol Biol Rev.* 62(3):775-806). These genetically engineered crops are now widely used in American agriculture and have provided the farmer with an environmentally friendly alternative to traditional insect-control methods. In addition, potatoes genetically engineered to contain pesticidal Cry toxins have been sold to the American farmer. While they have proven to be very successful commercially, these genetically engineered, insect-resistant crop plants provide resistance to only a narrow range of the economically important insect pests.

Accordingly, there remains a need for new Bt toxins with a broader range of insecticidal activity against insect pests, e.g., toxins which are active against a greater variety of insects. In addition, there remains a need for biopesticides having activity against a variety of insect pests and for biopesticides which have improved insecticidal activity.

SUMMARY

Compositions and methods are provided for impacting insect pests. More specifically, the embodiments of the present disclosure relate to methods of impacting insects utilizing nucleotide sequences encoding insecticidal peptides to produce transformed microorganisms and plants that express an insecticidal polypeptide of the embodiments. In some embodiments, the nucleotide sequences encode polypeptides that are pesticidal for at least one insect belonging to the order *Lepidoptera*.

In some aspects, nucleic acid molecules and fragments and variants thereof are provided, which encode polypeptides that possess pesticidal activity against insect pests. The embodiments further provide fragments and variants of the disclosed nucleotide sequence that encode biologically active (e.g., insecticidal) polypeptides.

In some aspects, isolated pesticidal (e.g., insecticidal) polypeptides are provided, encoded by either a naturally occurring or a modified (e.g., mutagenized or manipulated) nucleic acid of the embodiments. In particular aspects, pesticidal proteins of the embodiments include fragments of full-length proteins and polypeptides that are produced from mutagenized nucleic acids designed to introduce particular amino acid sequences into the polypeptides of the embodiments. In particular aspects, the polypeptides have enhanced pesticidal activity relative to the activity of the naturally occurring polypeptide from which they are derived.

In some aspects, the nucleic acids of the embodiments can also be used to produce transgenic (e.g., transformed) monocot or dicot plants that are characterized by genomes that comprise at least one stably incorporated nucleotide construct comprising a coding sequence of the embodiments operably linked to a promoter that drives expression of the encoded pesticidal polypeptide. Accordingly, transformed plant cells, plant tissues, plants, and seeds thereof are also provided.

In a particular aspects, a transformed plant can be produced using a nucleic acid that has been optimized for increased expression in a host plant. For example, one of the pesticidal polypeptides of the embodiments can be back-translated to produce a nucleic acid comprising codons optimized for expression in a particular host, for example a crop plant such as a corn (Zea mays) plant. Expression of a coding sequence by such a transformed plant (e.g., dicot or monocot) will result in the production of a pesticidal polypeptide and confer increased insect resistance to the plant. In some aspects, transgenic plants expressing pesticidal polypeptides are provide that find use in methods for impacting various insect pests.

In some aspects pesticidal or insecticidal compositions are provided containing the insecticidal polypeptides of the embodiments, and can optionally comprise further insecticidal peptides. The embodiments encompass the application of such compositions to the environment of insect pests in order to impact the insect pests.

DETAILED DESCRIPTION

The disclosure is drawn to compositions and methods for impacting insect pests, particularly plant pests. More specifically, the isolated nucleic acid of the embodiments, and fragments and variants thereof, comprise nucleotide sequences that encode pesticidal polypeptides (e.g., proteins). The disclosed pesticidal proteins are biologically active (e.g., pesticidal) against insect pests such as, but not limited to, insect pests of the order Lepidoptera.

The compositions of the embodiments comprise isolated nucleic acids, and fragments and variants thereof, which encode pesticidal polypeptides, expression cassettes comprising nucleotide sequences of the embodiments, isolated pesticidal proteins, and pesticidal compositions. Some embodiments provide modified pesticidal polypeptides having improved insecticidal activity against Lepidopterans relative to the pesticidal activity of the corresponding wild-type protein. The embodiments further provide plants and microorganisms transformed with these novel nucleic acids, and methods involving the use of such nucleic acids, pesticidal compositions, transformed organisms, and products thereof in impacting insect pests.

The nucleic acids and nucleotide sequences of the embodiments may be used to transform any organism to produce the encoded pesticidal proteins. Methods are provided that involve the use of such transformed organisms to impact or control plant pests. The nucleic acids and nucleotide sequences of the embodiments may also be used to transform organelles such as chloroplasts (McBride et al. (1995) Biotechnology 13: 362-365; and Kota et al. (1999) Proc. Natl. Acad. Sci. USA 96: 1840-1845).

The embodiments further relate to the identification of fragments and variants of the naturally-occurring coding sequence that encode biologically active pesticidal proteins. The nucleotide sequences of the embodiments find direct use in methods for impacting pests, particularly insect pests such as pests of the order Lepidoptera. Accordingly, the embodiments provide new approaches for impacting insect pests that do not depend on the use of traditional, synthetic chemical insecticides. The embodiments involve the discovery of naturally-occurring, biodegradable pesticides and the genes that encode them.

The embodiments further provide fragments and variants of the naturally occurring coding sequence that also encode biologically active (e.g., pesticidal) polypeptides. The nucleic acids of the embodiments encompass nucleic acid or nucleotide sequences that have been optimized for expression by the cells of a particular organism, for example nucleic acid sequences that have been back-translated (i.e., reverse translated) using plant-preferred codons based on the amino acid sequence of a polypeptide having enhanced pesticidal activity. The embodiments further provide mutations which confer improved or altered properties on the polypeptides of the embodiments. See, e.g. U.S. Pat. No. 7,462,760.

In the description that follows, a number of terms are used extensively. The following definitions are provided to facilitate understanding of the embodiments.

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The above-defined terms are more fully defined by reference to the specification as a whole.

As used herein, "nucleic acid" includes reference to a deoxyribonucleotide or ribonucleotide polymer in either single- or double-stranded form, and unless otherwise limited, encompasses known analogues (e.g., peptide nucleic acids) having the essential nature of natural nucleotides in that they hybridize to single-stranded nucleic acids in a manner similar to that of naturally occurring nucleotides.

As used herein, the terms "encoding" or "encoded" when used in the context of a specified nucleic acid mean that the nucleic acid comprises the requisite information to direct translation of the nucleotide sequence into a specified protein. The information by which a protein is encoded is specified by the use of codons. A nucleic acid encoding a protein may comprise non-translated sequences (e.g., introns) within translated regions of the nucleic acid or may lack such intervening non-translated sequences (e.g., as in cDNA).

As used herein, "full-length sequence" in reference to a specified polynucleotide or its encoded protein means having the entire nucleic acid sequence or the entire amino acid sequence of a native (non-synthetic), endogenous sequence. A full-length polynucleotide encodes the full-length, catalytically active form of the specified protein.

As used herein, the term "antisense" used in the context of orientation of a nucleotide sequence refers to a duplex polynucleotide sequence that is operably linked to a promoter in an orientation where the antisense strand is transcribed. The antisense strand is sufficiently complementary to an endogenous transcription product such that translation of the endogenous transcription product is often inhibited. Thus, where the term "antisense" is used in the context of a particular nucleotide sequence, the term refers to the complementary strand of the reference transcription product.

The terms "polypeptide," "peptide," and "protein" are used interchangeably herein to refer to a polymer of amino acid residues. The terms apply to amino acid polymers in which one or more amino acid residues is an artificial chemical analogue of a corresponding naturally occurring amino acid, as well as to naturally occurring amino acid polymers.

The terms "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass known analogues of natural amino acids that can function in a similar manner as naturally occurring amino acids.

Polypeptides of the embodiments can be produced either from a nucleic acid disclosed herein, or by the use of standard molecular biology techniques. For example, a protein of the embodiments can be produced by expression of a recombinant nucleic acid of the embodiments in an appropriate host cell, or alternatively by a combination of ex vivo procedures.

As used herein, the terms "isolated" and "purified" are used interchangeably to refer to nucleic acids or polypeptides or biologically active portions thereof that are substantially or essentially free from components that normally accompany or interact with the nucleic acid or polypeptide as found in its naturally occurring environment. Thus, an isolated or purified nucleic acid or polypeptide is substantially free of other cellular material or culture medium when produced by recombinant techniques, or substantially free of chemical precursors or other chemicals when chemically synthesized.

An "isolated" nucleic acid is generally free of sequences (such as, for example, protein-encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acids can contain less than about 5 kb, 4 kb, 3 kb, 2 kb, 1 kb, 0.5 kb, or 0.1 kb of nucleotide sequences that naturally flank the nucleic acids in genomic DNA of the cell from which the nucleic acid is derived.

As used herein, the term "isolated" or "purified" as it is used to refer to a polypeptide of the embodiments means that the isolated protein is substantially free of cellular material and includes preparations of protein having less than about 30%, 20%, 10%, or 5% (by dry weight) of contaminating protein. When the protein of the embodiments or biologically active portion thereof is recombinantly produced, culture medium represents less than about 30%, 20%, 10%, or 5% (by dry weight) of chemical precursors or non-protein-of-interest chemicals.

A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes.

As used herein a "non-genomic nucleic acid sequence" or "non-genomic nucleic acid molecule" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments, the non-genomic nucleic acid molecule is a cDNA. In some embodiments, the non-genomic nucleic acid molecule is a synthetic nucleic acid sequence.

Throughout the specification, the word "comprising," or variations such as "comprises" or "comprising," will be understood to imply the inclusion of a stated element, integer or step, or group of elements, integers or steps, but not the exclusion of any other element, integer or step, or group of elements, integers or steps.

As used herein, the term "impacting insect pests" refers to effecting changes in insect feeding, growth, and/or behavior at any stage of development, including but not limited to: killing the insect; retarding growth; preventing reproductive capability; antifeedant activity; and the like.

As used herein, the terms "pesticidal activity" and "insecticidal activity" are used synonymously to refer to activity of an organism or a substance (such as, for example, a protein) that can be measured by, but is not limited to, pest mortality, pest weight loss, pest repellency, and other behavioral and physical changes of a pest after feeding and exposure for an appropriate length of time. Thus, an organism or substance having pesticidal activity adversely impacts at least one measurable parameter of pest fitness. For example, "pesticidal proteins" are proteins that display pesticidal activity by themselves or in combination with other proteins.

As used herein, the term "pesticidally effective amount" means a quantity of a substance or organism that has pesticidal activity when present in the environment of a pest. For each substance or organism, the pesticidally effective amount is determined empirically for each pest affected in a specific environment. Similarly, an "insecticidally effective amount" may be used to refer to a "pesticidally effective amount" when the pest is an insect pest.

As used herein, the term "recombinantly engineered" or "engineered" means the utilization of recombinant DNA technology to introduce (e.g., engineer) a change in the protein structure based on an understanding of the protein's mechanism of action and a consideration of the amino acids being introduced, deleted, or substituted.

As used herein, the term "mutant nucleotide sequence" or "mutation" or "mutagenized nucleotide sequence" means a nucleotide sequence that has been mutagenized or altered to contain one or more nucleotide residues (e.g., base pair) that is not present in the corresponding wild-type sequence. Such mutagenesis or alteration consists of one or more additions, deletions, or substitutions or replacements of nucleic acid residues. When mutations are made by adding, removing, or replacing an amino acid of a proteolytic site, such addition, removal, or replacement may be within or adjacent to the proteolytic site motif, so long as the object of the mutation is accomplished (i.e., so long as proteolysis at the site is changed).

A mutant nucleotide sequence can encode a mutant insecticidal toxin showing improved or decreased insecticidal activity, or an amino acid sequence which confers improved or decreased insecticidal activity on a polypeptide containing it. As used herein, the term "mutant" or "mutation" in the context of a protein a polypeptide or amino acid sequence refers to a sequence which has been mutagenized or altered to contain one or more amino acid residues that are not present in the corresponding wild-type sequence. Such mutagenesis or alteration consists of one or more additions, deletions, or substitutions or replacements of amino acid residues. A mutant polypeptide shows improved or decreased insecticidal activity, or represents an amino acid sequence which confers improved insecticidal activity on a polypeptide containing it. Thus, the term "mutant" or "mutation" refers to either or both of the mutant nucleotide sequence and the encoded amino acids. Mutants may be used alone or in any compatible combination with other mutants of the embodiments or with other mutants. A "mutant polypeptide" may conversely show a decrease in insecticidal activity. Where more than one mutation is added to a particular nucleic acid or protein, the mutations may be added at the same time or sequentially; if sequentially, mutations may be added in any suitable order.

As used herein, the term "improved insecticidal activity" or "improved pesticidal activity" refers to an insecticidal polypeptide of the embodiments that has enhanced insecticidal activity relative to the activity of its corresponding wild-type protein, and/or an insecticidal polypeptide that is effective against a broader range of insects, and/or an insecticidal polypeptide having specificity for an insect that is not susceptible to the toxicity of the wild-type protein. A finding of improved or enhanced pesticidal activity requires a demonstration of an increase of pesticidal activity of at least 10%, against the insect target, or at least 20%, 25%, 30%, 35%, 40%, 45%, 50%, 60%, 70%, 100%, 150%, 200%, or 300% or greater increase of pesticidal activity relative to the pesticidal activity of the wild-type insecticidal polypeptide determined against the same insect.

For example, an improved pesticidal or insecticidal activity is provided where a wider or narrower range of insects is impacted by the polypeptide relative to the range of insects that is affected by a wild-type Bt toxin. A wider range of impact may be desirable where versatility is desired, while a narrower range of impact may be desirable where, for example, beneficial insects might otherwise be impacted by use or presence of the toxin. While the embodiments are not bound by any particular mechanism of action, an improved pesticidal activity may also be provided by changes in one or more characteristics of a polypeptide; for example, the stability or longevity of a polypeptide in an insect gut may be increased relative to the stability or longevity of a corresponding wild-type protein.

The term "toxin" as used herein refers to a polypeptide showing pesticidal activity or insecticidal activity or improved pesticidal activity or improved insecticidal activity. "Bt" or "*Bacillus thuringiensis*" toxin is intended to include the broader class of Cry toxins found in various strains of Bt, which includes such toxins as, for example, Cry1s, Cry2s, or Cry3s.

The terms "proteolytic site" or "cleavage site" refer to an amino acid sequence which confers sensitivity to a class of proteases or a particular protease such that a polypeptide containing the amino acid sequence is digested by the class of proteases or particular protease. A proteolytic site is said to be "sensitive" to the protease(s) that recognize that site. It is appreciated in the art that the efficiency of digestion will vary, and that a decrease in efficiency of digestion can lead to an increase in stability or longevity of the polypeptide in an insect gut. Thus, a proteolytic site may confer sensitivity to more than one protease or class of proteases, but the efficiency of digestion at that site by various proteases may vary. Proteolytic sites include, for example, trypsin sites, chymotrypsin sites, and elastase sites.

Research has shown that the insect gut proteases of Lepidopterans include trypsins, chymotrypsins, and elastases. See, e.g., Lenz et al. (1991) *Arch. Insect Biochem. Physiol.* 16: 201-212; and Hedegus et al. (2003) *Arch. Insect Biochem. Physiol.* 53: 30-47. For example, about 18 different trypsins have been found in the midgut of *Helicoverpa armigera* larvae (see Gatehouse et al. (1997) *Insect Biochem. Mol. Biol.* 27: 929-944). The preferred proteolytic substrate sites of these proteases have been investigated. See, e.g., Peterson et al. (1995) *Insect Biochem. Mol. Biol.* 25: 765-774.

Efforts have been made to understand the mechanism of action of Bt toxins and to engineer toxins with improved properties. It has been shown that insect gut proteases can affect the impact of Bt Cry proteins on the insect. Some proteases activate the Cry proteins by processing them from a "protoxin" form into a toxic form, or "toxin." See, Oppert (1999) *Arch. Insect Biochem. Phys.* 42: 1-12; and Carroll et al. (1997) *J. Invertebrate Pathology* 70: 41-49. This activation of the toxin can include the removal of the N- and C-terminal peptides from the protein and can also include internal cleavage of the protein. Other proteases can degrade the Cry proteins. See Oppert, ibid.

A comparison of the amino acid sequences of Cry toxins of different specificities reveals five highly-conserved sequence blocks. Structurally, the toxins comprise three distinct domains which are, from the N- to C-terminus: a cluster of seven alpha-helices implicated in pore formation (referred to as "domain 1"), three anti-parallel beta sheets implicated in cell binding (referred to as "domain 2"), and a beta sandwich (referred to as "domain 3"). The location and properties of these domains are known to those of skill in the art. See, for example, Li et al. (1991) *Nature*, 305:815-821 and Morse et al. (2001) *Structure*, 9:409-417. When reference is made to a particular domain, such as domain 1, it is understood that the exact endpoints of the domain with regard to a particular sequence are not critical so long as the sequence or portion thereof includes sequence that provides at least some function attributed to the particular domain. Thus, for example, when referring to "domain 1," it is intended that a particular sequence includes a cluster of seven alpha-helices, but the exact endpoints of the sequence used or referred to with regard to that cluster are not critical. One of skill in the art is familiar with the determination of such endpoints and the evaluation of such functions.

In an effort to better characterize and improve Bt toxins, strains of the bacterium Bt were studied. Crystal preparations prepared from cultures of the Bt strains were discovered to have pesticidal activity against numerous Lepidopteran pests (see, e.g., Experimental Example 1). An effort was undertaken to identify the nucleotide sequences encoding the crystal proteins from the selected strains, and the wild-type (i.e., naturally occurring) nucleic acids of the embodiments were isolated from these bacterial strains, cloned into an expression vector, and transformed into *E. coli*. Depending upon the characteristics of a given preparation, it was recognized that the demonstration of pesticidal activity sometimes required trypsin pretreatment to activate the pesticidal proteins. Thus, it is understood that some pesticidal proteins require protease digestion (e.g., by trypsin, chymotrypsin, and the like) for activation, while other proteins are biologically active (e.g., pesticidal) in the absence of activation.

Such molecules may be altered by means described, for example, U.S. Pat. No. 7,462,760. In addition, nucleic acid sequences may be engineered to encode polypeptides that contain additional mutations that confer improved or altered pesticidal activity relative to the pesticidal activity of the naturally occurring polypeptide. The nucleotide sequences of such engineered nucleic acids comprise mutations not found in the wild type sequences.

The mutant polypeptides of the embodiments are generally prepared by a process that involves the steps of: obtaining a nucleic acid sequence encoding a Cry family polypeptide; analyzing the structure of the polypeptide to identify particular "target" sites for mutagenesis of the underlying gene sequence based on a consideration of the proposed function of the target domain in the mode of action of the toxin; introducing one or more mutations into the nucleic acid sequence to produce a desired change in one or more amino acid residues of the encoded polypeptide sequence; and assaying the polypeptide produced for pesticidal activity.

Many of the Bt insecticidal toxins are related to various degrees by similarities in their amino acid sequences and tertiary structure and means for obtaining the crystal structures of Bt toxins are well known. Exemplary high-resolution crystal structure solution of both the Cry3A and Cry3B polypeptides are available in the literature. The solved structure of the Cry3A gene (Li et al. (1991) *Nature* 353: 815-821) provides insight into the relationship between structure and function of the toxin. A combined consideration of the published structural analyses of Bt toxins and the reported function associated with particular structures, motifs, and the like indicates that specific regions of the toxin are correlated with particular functions and discrete steps of the mode of action of the protein. For example, many toxins isolated from Bt are generally described as comprising three domains: a seven-helix bundle that is involved in pore formation, a three-sheet domain that has been implicated in receptor binding, and a beta-sandwich motif (Li et al. (1991) *Nature* 305: 815-821).

As reported in U.S. Pat. Nos. 7,105,332, and 7,462,760, the toxicity of Cry proteins can be improved by targeting the region located between alpha helices 3 and 4 of domain 1 of the toxin. This theory was premised on a body of knowledge concerning insecticidal toxins, including: 1) that alpha helices 4 and 5 of domain 1 of Cry3A toxins had been reported to insert into the lipid bilayer of cells lining the midgut of susceptible insects (Gazit et al. (1998) *Proc. Natl. Acad. Sci. USA* 95: 12289-12294); 2) the inventors' knowledge of the location of trypsin and chymotrypsin cleavage sites within the amino acid sequence of the wild-type protein; 3) the observation that the wild-type protein was more active against certain insects following in vitro activation by trypsin or chymotrypsin treatment; and 4) reports that digestion of toxins from the 3' end resulted in decreased toxicity to insects.

A series of mutations may be created and placed in a variety of background sequences to create novel polypeptides having enhanced or altered pesticidal activity. See, e.g., U.S. Pat. No. 7,462,760. These mutants include, but are not limited to: the addition of at least one more protease-sensitive site (e.g., trypsin cleavage site) in the region located between helices 3 and 4 of domain 1; the replacement of an original protease-sensitive site in the wild-type sequence with a different protease-sensitive site; the addition of multiple protease-sensitive sites in a particular location; the addition of amino acid residues near protease-sensitive site(s) to alter folding of the polypeptide and thus enhance digestion of the polypeptide at the protease-sensitive site(s); and adding mutations to protect the polypeptide from degradative digestion that reduces toxicity (e.g., making a series of mutations wherein the wild-type amino acid is replaced by valine to protect the polypeptide from digestion). Mutations may be used singly or in any combination to provide polypeptides of the embodiments.

Homologous sequences were identified by similarity search on the non-redundant database (nr) of National Center for Bioinformatics Information (NCBI) using BLAST and PSI-BLAST. The homologous proteins were made up of Cry toxins primarily from *Bacillus thuringiensis*.

A mutation which is an additional or alternative protease-sensitive site may be sensitive to several classes of proteases such as serine proteases, which include trypsin and chymotrypsin, or enzymes such as elastase. Thus, a mutation which is an additional or alternative protease-sensitive site may be designed so that the site is readily recognized and/or cleaved by a category of proteases, such as mammalian proteases or insect proteases. A protease-sensitive site may also be designed to be cleaved by a particular class of enzymes or a particular enzyme known to be produced in an organism, such as, for example, a chymotrypsin produced by the corn earworm *Heliothis zea* (Lenz et al. (1991) *Arch. Insect Biochem. Physiol.* 16: 201-212). Mutations may also confer resistance to proteolytic digestion, for example, to digestion by chymotrypsin at the C-terminus of the peptide.

The presence of an additional and/or alternative protease-sensitive site in the amino acid sequence of the encoded polypeptide can improve the pesticidal activity and/or specificity of the polypeptide encoded by the nucleic acids of the embodiments. Accordingly, the nucleotide sequences of the embodiments can be recombinantly engineered or manipulated to produce polypeptides having improved or altered insecticidal activity and/or specificity compared to that of an unmodified wild-type toxin. In addition, the mutations disclosed herein may be placed in or used in conjunction with other nucleotide sequences to provide improved properties. For example, a protease-sensitive site that is readily cleaved by insect chymotrypsin, e.g., a chymotrypsin found in the bertha armyworm or the corn earworm (Hegedus et al. (2003) *Arch. Insect Biochem. Physiol.* 53: 30-47; and Lenz et al. (1991) *Arch. Insect Biochem. Physiol.* 16: 201-212), may be placed in a Cry background sequence to provide improved toxicity to that sequence. In this manner, the embodiments provide toxic polypeptides with improved properties.

For example, a mutagenized Cry nucleotide sequence can comprise additional mutants that comprise additional codons that introduce a second trypsin-sensitive amino acid sequence (in addition to the naturally occurring trypsin site) into the encoded polypeptide. An alternative addition mutant of the embodiments comprises additional codons designed to introduce at least one additional different protease-sensitive site into the polypeptide, for example, a chymotrypsin-sensitive site located immediately 5' or 3' of the naturally occurring trypsin site. Alternatively, substitution mutants may be created in which at least one codon of the nucleic acid that encodes the naturally occurring protease-sensitive site is destroyed and alternative codons are introduced into the nucleic acid sequence in order to provide a different (e.g., substitute) protease-sensitive site. A replacement mutant may also be added to a Cry sequence in which the naturally-occurring trypsin cleavage site present in the encoded polypeptide is destroyed and a chymotrypsin or elastase cleavage site is introduced in its place.

It is recognized that any nucleotide sequence encoding the amino acid sequences that are proteolytic sites or putative proteolytic sites (for example, sequences such as RR, or LKM) can be used and that the exact identity of the codons used to introduce any of these cleavage sites into a variant polypeptide may vary depending on the use, i.e., expression in a particular plant species. It is also recognized that any of the disclosed mutations can be introduced into any polynucleotide sequence of the embodiments that comprises the codons for amino acid residues that provide the native trypsin cleavage site that is targeted for modification. Accordingly, variants of either full-length toxins or fragments thereof can be modified to contain additional or alternative cleavage sites, and these embodiments are intended to be encompassed by the scope of the embodiments disclosed herein.

It will be appreciated by those of skill in the art that any useful mutation may be added to the sequences of the embodiments so long as the encoded polypeptides retain pesticidal activity. Thus, sequences may also be mutated so that the encoded polypeptides are resistant to proteolytic digestion by chymotrypsin. More than one recognition site can be added in a particular location in any combination, and multiple recognition sites can be added to or removed from the toxin. Thus, additional mutations can comprise three, four, or more recognition sites. It is to be recognized that multiple mutations can be engineered in any suitable polynucleotide sequence; accordingly, either full-length sequences or fragments thereof can be modified to contain additional or alternative cleavage sites as well as to be resistant to proteolytic digestion. In this manner, the embodiments provide Cry toxins containing mutations that improve pesticidal activity as well as improved compositions and methods for impacting pests using other Bt toxins.

Mutations may protect the polypeptide from protease degradation, for example by removing putative proteolytic sites such as putative serine protease sites and elastase recognition sites from different areas. Some or all of such putative sites may be removed or altered so that proteolysis at the location of the original site is decreased. Changes in proteolysis may be assessed by comparing a mutant polypeptide with wild-type toxins or by comparing mutant toxins which differ in their amino acid sequence. Putative proteolytic sites and proteolytic sites include, but are not limited to, the following sequences: RR, a trypsin cleavage site; LKM, a chymotrypsin site; and a trypsin site. These sites may be altered by the addition or deletion of any number and kind of amino acid residues, so long as the pesticidal activity of the polypeptide is increased. Thus, polypeptides encoded by nucleotide sequences comprising mutations will comprise at least one amino acid change or addition relative to the native or background sequence, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 32, 35, 38, 40, 45, 47, 50, 60, 70, 80, 90, 100, 110, 120, 130, 140, 150, 160, 170, 180, 190, 200, 210, 220, 230, 240, 250, 260, 270, or 280 or more amino acid changes or additions. Pesticidal activity of a polypeptide may also be improved by truncation of the native or full-length sequence, as is known in the art.

Compositions of the embodiments include nucleic acids, and fragments and variants thereof that encode pesticidal polypeptides. In particular, the embodiments provide for isolated nucleic acid molecules comprising nucleotide sequences encoding the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, and SEQ ID NO: 284, and the nucleotide sequences encoding said amino acid sequence, for example the nucleotide sequence set forth in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257, SEQ ID NO: 259, SEQ ID NO: 261, SEQ ID NO: 263, SEQ ID NO: 265, SEQ ID NO: 267, and SEQ ID NO: 269, and fragments and variants thereof.

In particular, the embodiments provide for isolated nucleic acid molecules encoding the amino acid sequence shown in SEQ ID NO: 64, SEQ ID NO: 152, SEQ ID NO: 170 or SEQ ID NO: 184 or the nucleotide sequences encoding said amino acid sequence, for example the nucleotide sequence set forth in SEQ ID NO: 63, SEQ ID NO: 151, SEQ ID NO: 169 or SEQ ID NO: 183, and fragments and variants thereof.

Also of interest are optimized nucleotide sequences encoding the pesticidal proteins of the embodiments. As used herein, the phrase "optimized nucleotide sequences" refers to nucleic acids that are optimized for expression in a particular organism, for example a plant. Optimized nucleotide sequences may be prepared for any organism of interest using methods known in the art. See, for example, U.S. Pat. No. 7,462,760, which describes an optimized nucleotide sequence encoding a disclosed pesticidal protein. In this example, the nucleotide sequence was prepared by reverse-translating the amino acid sequence of the protein and changing the nucleotide sequence so as to comprise maize-preferred codons while still encoding the same amino acid sequence. This procedure is described in more detail by Murray et al. (1989) *Nucleic Acids Res.* 17:477-498. Optimized nucleotide sequences find use in increasing expression of a pesticidal protein in a plant, for example monocot plants of the Gramineae (Poaceae) family such as, for example, a maize or corn plant.

In particular embodiments, pesticidal proteins of the embodiments provide full-length insecticidal polypeptides, fragments of full-length insecticidal polypeptides, and variant polypeptides that are produced from mutagenized nucleic acids designed to introduce particular amino acid sequences into polypeptides of the embodiments. In particular embodiments, the amino acid sequences that are introduced into the polypeptides comprise a sequence that provides a cleavage site for an enzyme such as a protease.

It is known in the art that the pesticidal activity of Bt toxins is typically activated by cleavage of the peptide in the insect gut by various proteases. Because peptides may not always be cleaved with complete efficiency in the insect gut, fragments of a full-length toxin may have enhanced pesticidal activity in comparison to the full-length toxin itself. Thus, some of the polypeptides of the embodiments include fragments of a full-length insecticidal polypeptide, and some of the polypeptide fragments, variants, and mutations will have enhanced pesticidal activity relative to the activity of the naturally occurring insecticidal polypeptide from which they are derived, particularly if the naturally occurring insecticidal polypeptide is not activated in vitro with a protease prior to screening for activity. Thus, the present application encompasses truncated versions or fragments of the sequences.

Mutations may be placed into any background sequence, including such truncated polypeptides, so long as the polypeptide retains pesticidal activity. One of skill in the art can readily compare two or more proteins with regard to pesticidal activity using assays known in the art or described elsewhere herein. It is to be understood that the polypeptides of the embodiments can be produced either by expression of a nucleic acid disclosed herein, or by the use of standard molecular biology techniques.

It is recognized that the pesticidal proteins may be oligomeric and will vary in molecular weight, number of residues, component peptides, activity against particular pests, and other characteristics. However, by the methods set forth herein, proteins active against a variety of pests may be isolated and characterized. The pesticidal proteins of the embodiments can be used in combination with other Bt toxins or other insecticidal proteins to increase insect target range. Furthermore, the use of the pesticidal proteins of the embodiments in combination with other Bt toxins or other insecticidal principles of a distinct nature has particular utility for the prevention and/or management of insect resistance. Other insecticidal agents include protease inhibitors (both serine and cysteine types), α-amylase, and peroxidase.

Fragments and variants of the nucleotide and amino acid sequences and the polypeptides encoded thereby are also encompassed by the embodiments. As used herein the term "fragment" refers to a portion of a nucleotide sequence of a polynucleotide or a portion of an amino acid sequence of a polypeptide of the embodiments. Fragments of a nucleotide sequence may encode protein fragments that retain the biological activity of the native or corresponding full-length protein and hence possess pesticidal activity. Thus, it is acknowledged that some of the polynucleotide and amino acid sequences of the embodiments can correctly be referred to as both fragments and mutants.

It is to be understood that the term "fragment," as it is used to refer to nucleic acid sequences of the embodiments, also encompasses sequences that are useful as hybridization probes. This class of nucleotide sequences generally does not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the embodiments.

A fragment of a nucleotide sequence of the embodiments that encodes a biologically active portion of a pesticidal protein of the embodiments will encode at least 15, 25, 30, 50, 100, 200, 250 or 300 contiguous amino acids, or up to the total number of amino acids present in a pesticidal polypeptide of the embodiments. Fragments of a nucleotide sequence of the embodiments that are useful as hybridization probes or PCR primers generally need not encode a biologically active portion of a pesticidal protein. Thus, a fragment of a nucleic acid of the embodiments may encode a biologically active portion of a pesticidal protein, or it may be a fragment that can be used as a hybridization probe or PCR primer using methods disclosed herein. A biologically active portion of a pesticidal protein can be prepared by isolating a portion of one of the nucleotide sequences of the embodiments, expressing the encoded portion of the pesticidal protein (e.g., by recombinant expression in vitro), and assessing the activity of the encoded portion of the pesticidal protein.

Nucleic acids that are fragments of a nucleotide sequence of the embodiments comprise at least 16, 20, 50, 75, 100, 150, 200, 250, 300, 350, 400, 450, 500, 600, 700, 800, 850, 900 or 950 nucleotides, or up to the number of nucleotides present in a nucleotide sequence disclosed herein. Particular embodiments envision fragments derived from (e.g., produced from) a first nucleic acid of the embodiments, wherein the fragment encodes a truncated toxin having pesticidal activity. Truncated polypeptides encoded by the polynucleotide fragments of the embodiments are having pesticidal activity that is either equivalent to, or improved, relative to the activity of the corresponding full-length polypeptide encoded by the first nucleic acid from which the fragment is derived. It is envisioned that such nucleic acid fragments of the embodiments may be truncated at the 3' end of the native or corresponding full-length coding sequence. Nucleic acid fragments may also be truncated at both the 5' and 3' end of the native or corresponding full-length coding sequence.

The term "variants" is used herein to refer to substantially similar sequences. For nucleotide sequences, conservative variants include those sequences that, because of the degeneracy of the genetic code, encode the amino acid sequence of one of the pesticidal polypeptides of the embodiments. Those having ordinary skill in the art will readily appreciate that due to the degeneracy of the genetic code, a multitude of nucleotide sequences encoding of the present disclosure exist.

In some embodiments, the nucleic acid molecule encoding the polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments, the non-genomic nucleic acid molecule is a cDNA. In some embodiments, the non-genomic nucleic acid molecule is a synthetic nucleic acid sequence.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea* maize codon usage table can be also found at kazusa.or.jp/codon/cgi-bin/showcodon.cgi?species=4577, which can be accessed using the www prefix.

A *Glycine max* codon usage table is shown in Table 3 and can also be found at kazusa.or.jp/codon/cgi-bin/showcodon.cgi?species=3847&aa=1&style=N, which can be accessed using the www prefix.

The skilled artisan will further appreciate that changes can be introduced by mutation of the nucleic acid sequences thereby leading to changes in the amino acid sequence of the encoded polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Naturally occurring allelic variants such as these can be identified with the use of well-known molecular biology techniques, such as, for example, polymerase chain reaction (PCR) and hybridization techniques as outlined herein.

In some embodiments the polynucleotide encoding the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268 or SEQ ID NO: 270, is a non-genomic nucleic acid sequence.

Variant nucleotide sequences also include synthetically derived nucleotide sequences, such as those generated, for example, by using site-directed mutagenesis but which still encode a pesticidal protein of the embodiments, such as a mutant toxin. Generally, variants of a particular nucleotide sequence of the embodiments will have at least about 70%, 75%, 80%, 85%, 86%, 87%, 88%, 89%, 90%, 91%, 92%, 93%, 94%, 95%, 96%, 97%, 98%, 99%, or more sequence identity to that particular nucleotide sequence as determined by sequence alignment programs described elsewhere herein using default parameters. A variant of a nucleotide sequence of the embodiments may differ from that sequence by as few as 1-15 nucleotides, as few as 1-10, such as 6-10, as few as 5, as few as 4, 3, 2, or even 1 nucleotide.

Variants of a particular nucleotide sequence of the embodiments (i.e., an exemplary nucleotide sequence) can also be evaluated by comparison of the percent sequence identity between the polypeptide encoded by a variant nucleotide sequence and the polypeptide encoded by the reference nucleotide sequence. Thus, for example, isolated nucleic acids that encode a polypeptide with a given percent sequence identity to the polypeptides SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268 or SEQ ID NO: 270 are disclosed. Percent sequence identity between any two polypeptides can be calculated using sequence alignment programs described elsewhere herein using default parameters. Where any given pair of polynucleotides of the embodiments is evaluated by comparison of the percent sequence identity shared by the two polypeptides they encode, the percent sequence identity between the two encoded polypeptides is at least about 40%, 45%, 50%, 55%, 60%, 65%, 70%, generally at least about 75%, 80%, 85%, at least about 90%, 91%, 92%, 93%, 94%, 95%, 96%, 97%, or at least about 98%, 99% or more sequence identity.

As used herein, the term "variant protein" encompasses polypeptides that are derived from a native protein by: deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Accordingly, the term "variant protein" encompasses biologically active fragments of a native protein that comprise a sufficient number of contiguous amino acid residues to retain the biological activity of the native protein, i.e., to have pesticidal activity. Such pesticidal activity may be different or improved relative to the native protein or it may be unchanged, so long as pesticidal activity is retained.

Variant proteins encompassed by the embodiments are biologically active, that is they continue to possess the desired biological activity of the native protein, that is, pesticidal activity as described herein. Such variants may result from, for example, genetic polymorphism or from human manipulation. Biologically active variants of a native pesticidal protein of the embodiments will have at least about 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence for the native protein as determined by sequence alignment programs described elsewhere herein using default parameters. A biologically active variant of a protein of the embodiments may differ from that protein by as few as 1-15 amino acid residues, as few as 1-10, such as 6-10, as few as 5, as few as 4, 3, 2, or even 1 amino acid residue.

In some embodiments, the insecticidal polypeptide has at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268 or SEQ ID NO: 270.

In some embodiments, the polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments, the polypeptide has increased digestibility of proteolytic fragments in an insect gut. In some embodiments, the polypeptide has increased stability in an insect gut. Models for digestion by simulated simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

The embodiments further encompass a microorganism that is transformed with at least one nucleic acid of the embodiments, with an expression cassette comprising the nucleic acid, or with a vector comprising the expression cassette. In some embodiments, the microorganism is one that multiplies on plants. An embodiment of the disclosure relates to an encapsulated pesticidal protein which comprises a transformed microorganism capable of expressing at least one pesticidal protein of the embodiments.

The embodiments provide pesticidal compositions comprising a transformed microorganism of the embodiments. In such embodiments, the transformed microorganism is generally present in the pesticidal composition in a pesticidally effective amount, together with a suitable carrier. The embodiments also encompass pesticidal compositions comprising an isolated protein of the embodiments, alone or in combination with a transformed organism of the embodiments and/or an encapsulated pesticidal protein of the embodiments, in an insecticidally effective amount, together with a suitable carrier.

The embodiments further provide a method of increasing insect target range by using a pesticidal protein of the embodiments in combination with at least one other or "second" pesticidal protein. Any pesticidal protein known in the art can be employed in the methods of the embodiments. Such pesticidal proteins include, but are not limited to, Bt toxins, protease inhibitors, α-amylases, and peroxidases.

The embodiments also encompass transformed or transgenic plants comprising at least one nucleotide sequence of the embodiments. In some embodiments, the plant is stably transformed with a nucleotide construct comprising at least one nucleotide sequence of the embodiments operably linked to a promoter that drives expression in a plant cell. As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant expression cassette.

It is to be understood that as used herein the term "transgenic" includes any cell, cell line, callus, tissue, plant part, or plant the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, the term "plant" includes whole plants, plant organs (e.g., leaves, stems, roots, etc.), seeds, plant cells, and progeny of same. Parts of transgenic plants are within the scope of the embodiments and comprise, for example, plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like, originating in transgenic plants or their progeny previously transformed with a DNA molecule of the embodiments and therefore consisting at least in part of transgenic cells. The class of plants that can be used in the methods of the embodiments is generally as broad as the class of higher plants amenable to transformation techniques, including both monocotyledonous and dicotyledonous plants.

While the embodiments do not depend on a particular biological mechanism for increasing the resistance of a plant to a plant pest, expression of the nucleotide sequences of the embodiments in a plant can result in the production of the pesticidal proteins of the embodiments and in an increase in the resistance of the plant to a plant pest. The plants of the embodiments find use in agriculture in methods for impacting insect pests. Certain embodiments provide transformed crop plants, such as, for example, maize plants, which find use in methods for impacting insect pests of the plant, such as, for example, Lepidopteran pests.

A "subject plant or plant cell" is one in which genetic alteration, such as transformation, has been affected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e., with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

One of skill in the art will readily acknowledge that advances in the field of molecular biology such as site-specific and random mutagenesis, polymerase chain reaction methodologies, and protein engineering techniques provide an extensive collection of tools and protocols suitable for use to alter or engineer both the amino acid sequence and underlying genetic sequences of proteins of agricultural interest.

Thus, the proteins of the embodiments may be altered in various ways including amino acid substitutions, deletions, truncations, and insertions. Methods for such manipulations are generally known in the art. For example, amino acid sequence variants of the pesticidal proteins can be prepared by introducing mutations into a synthetic nucleic acid (e.g., DNA molecule). Methods for mutagenesis and nucleic acid alterations are well known in the art. For example, designed changes can be introduced using an oligonucleotide-mediated site-directed mutagenesis technique. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York), and the references cited therein.

The mutagenized nucleotide sequences of the embodiments may be modified so as to change about 1, 2, 3, 4, 5, 6, 8, 10, 12 or more of the amino acids present in the primary sequence of the encoded polypeptide. Alternatively, even more changes from the native sequence may be introduced such that the encoded protein may have at least about 1% or 2%, or about 3%, 4%, 5%, 6%, 7%, 8%, 9%, 10%, 11%, 12%, or even about 13%, 14%, 15%, 16%, 17%, 18%, 19%, or 20%, 21%, 22%, 23%, 24%, or 25%, 30%, 35%, or 40% or more of the codons altered, or otherwise modified compared to the corresponding wild-type protein. In the same manner, the encoded protein may have at least about 1% or 2%, or about 3%, 4%, 5%, 6%, 7%, 8%, 9%, 10%, 11%, 12%, or even about 13%, 14%, 15%, 16%, 17%, 18%, 19%, or 20%, 21%, 22%, 23%, 24%, or 25%, 30%, 35%, or 40% or more additional codons compared to the corresponding wild-type protein. It should be understood that the mutagenized nucleotide sequences of the embodiments are intended to encompass biologically functional, equivalent peptides which have pesticidal activity, such as an improved pesticidal activity as determined by antifeedant properties against European corn borer larvae. Such sequences may arise as a consequence of codon redundancy and functional equivalency that are known to occur naturally within nucleic acid sequences and the proteins thus encoded.

One of skill in the art would recognize that amino acid additions and/or substitutions are generally based on the relative similarity of the amino acid side-chain substituents, for example, their hydrophobicity, charge, size, and the like. Exemplary amino acid substitution groups that take various of the foregoing characteristics into consideration are well known to those of skill in the art and include: arginine and lysine; glutamate and aspartate; serine and threonine; glutamine and asparagine; and valine, leucine, and isoleucine.

Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be made.

Thus, the genes and nucleotide sequences of the embodiments include both the naturally occurring sequences and mutant forms. Likewise, the proteins of the embodiments encompass both naturally occurring proteins and variations (e.g., truncated polypeptides) and modified (e.g., mutant) forms thereof. Such variants will continue to possess the desired pesticidal activity. Obviously, the mutations that will be made in the nucleotide sequence encoding the variant must not place the sequence out of reading frame and generally will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays, such as insect-feeding assays. See, for example, Marrone et al. (1985) *J. Econ. Entomol.* 78: 290-293 and Czapla and Lang (1990) *J. Econ. Entomol.* 83: 2480-2485, herein incorporated by reference.

Variant nucleotide sequences and proteins also encompass sequences and proteins derived from a mutagenic and recombinogenic procedure such as DNA shuffling. With such a procedure, one or more different coding sequences can be manipulated to create a new pesticidal protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, full-length coding sequences, sequence motifs encoding a domain of interest, or any fragment of a nucleotide sequence of the embodiments may be shuffled between the nucleotide sequences of the embodiments and corresponding portions of other known Cry nucleotide sequences to obtain a new gene coding for a protein with an improved property of interest.

Properties of interest include, but are not limited to, pesticidal activity per unit of pesticidal protein, protein stability, and toxicity to non-target species particularly humans, livestock, and plants and microbes that express the pesticidal polypeptides of the embodiments. The embodiments are not bound by a particular shuffling strategy, only that at least one nucleotide sequence of the embodiments, or part thereof, is involved in such a shuffling strategy. Shuffling may involve only nucleotide sequences disclosed herein or may additionally involve shuffling of other nucleotide sequences known in the art. Strategies for DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

The nucleotide sequences of the embodiments can also be used to isolate corresponding sequences from other organisms, particularly other bacteria, and more particularly other *Bacillus* strains. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.), hereinafter "Sambrook". See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}P$ or any other detectable marker. Thus, for example, probes for hybridization can be made by labeling synthetic oligonucleotides based on the sequences of the embodiments. Methods for preparation of probes for hybridization and for construction of cDNA and genomic libraries are generally known in the art and are disclosed in Sambrook.

For example, an entire sequence disclosed herein, or one or more portions thereof, may be used as a probe capable of specifically hybridizing to corresponding sequences and messenger RNAs. To achieve specific hybridization under a variety of conditions, such probes include sequences that are unique to the sequences of the embodiments and are generally at least about 10 or 20 nucleotides in length. Such probes may be used to amplify corresponding Cry sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook).

Hybridization of such sequences may be carried out under stringent conditions. The term "stringent conditions" or "stringent hybridization conditions" as used herein refers to conditions under which a probe will hybridize to its target sequence to a detectably greater degree than to other sequences (e.g., at least 2-fold, 5-fold, or 10-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 or 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a final wash in 0.1×SSC at 60 to 65° C. for at least about 20 minutes. Optionally, wash buffers may comprise about 0.1% to about 1% SDS. The duration of hybridization is generally less than about 24 hours, usually about 4 to about 12 hours.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 872264, as modified in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244 (1988); Higgins et al. (1989) *CABIOS* 5:151-153; Corpet et al. (1988) *Nucleic Acids Res.* 16:10881-90; Huang et al. (1992) *CABIOS* 8:155-65; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the embodiments. BLAST protein searches can be performed with the BLASTX program, score=50, wordlength=3, to obtain amino acid sequences homologous to a protein or polypeptide of the embodiments. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See the National Center for Biotechnology Information website on the world wide web at ncbi.hlm.nih.gov. Alignment may also be performed manually by inspection.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e)(i) The term "substantial identity" of polynucleotide sequences means that a polynucleotide comprises a sequence that has at least 70%. 80%, 90%, or 95% or more sequence identity when compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes generally means sequence identity of at least 60%, 70%, 80%, 90%, or 95% or more sequence identity.

Another indication that nucleotide sequences are substantially identical is if two molecules hybridize to each other under stringent conditions. Generally, stringent conditions are selected to be about 5° C. lower than the $T_m$ for the specific sequence at a defined ionic strength and pH. However, stringent conditions encompass temperatures in the range of about 1° C. to about 20° C. lower than the $T_m$, depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(e)(ii) The term "substantial identity" in the context of a peptide indicates that a peptide comprises a sequence with at least 70%, 80%, 85%, 90%, 95%, or more sequence identity to a reference sequence over a specified comparison window. Optimal alignment for these purposes can be conducted using the global alignment algorithm of Needleman and Wunsch (1970) supra. An indication that two peptide sequences are substantially identical is that one peptide is immunologically reactive with antibodies raised against the second peptide. Thus, a peptide is substantially identical to a second peptide, for example, where the two peptides differ only by a conservative substitution. Peptides that are "substantially similar" share sequences as noted above except that residue positions that are not identical may differ by conservative amino acid changes.

The use of the term "nucleotide constructs" herein is not intended to limit the embodiments to nucleotide constructs comprising DNA. Those of ordinary skill in the art will recognize that nucleotide constructs, particularly polynucleotides and oligonucleotides composed of ribonucleotides and combinations of ribonucleotides and deoxyribonucleotides, may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures, and the like.

A further embodiment relates to a transformed organism such as an organism selected from the group consisting of plant and insect cells, bacteria, yeast, baculoviruses, protozoa, nematodes, and algae. The transformed organism comprises: a DNA molecule of the embodiments, an expression cassette comprising the said DNA molecule, or a vector comprising the said expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions, contiguous and in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the Cry toxin sequence to be under the transcriptional regulation of the regulatory regions. The DNA construct may additionally contain selectable marker genes.

The DNA construct will include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

The termination region may be native with the transcriptional initiation region, may be native with the operably linked DNA sequence of interest, may be native with the plant host, or may be derived from another source (i.e., foreign or heterologous to the promoter, the sequence of interest, the plant host, or any combination thereof).

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray et al., supra. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli*, or eukaryotic cells such as yeast, insect, amphibian, or mammalian cells, or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86: 6126-6130); potyvirus leaders, for example, TEV leader (Tobacco Etch Virus) (Gallie et al. (1995) *Gene* 165(2): 233-238), MDMV leader (Maize Dwarf Mosaic Virus), human immunoglobulin heavy-chain binding protein (BiP) (Macejak et al. (1991) *Nature* 353: 90-94); untranslated leader from the coat protein mRNA of alfalfa mosaic virus (AMV RNA 4) (Jobling et al. (1987) *Nature* 325: 622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81: 382-385). See also, Della-Cioppa et al. (1987) *Plant Physiol.* 84: 965-968.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible, or other promoters for expression in the host organism. Suitable constitutive promoters for use in a plant host cell include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313: 810-812); rice actin (McElroy et al. (1990) *Plant Cell* 2: 163-171); ubiquitin (Christensen et al. (1989) *Plant Mol. Biol.* 12: 619-632 and Christensen et al. (1992) *Plant Mol. Biol.* 18: 675-689); pEMU (Last et al. (1991) *Theor. Appl. Genet.* 81: 581-588); MAS (Velten et al. (1984) *EMBO J.* 3:2723-2730); ALS promoter (U.S. Pat. No. 5,659,026), and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142; and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan (1990) *Ann. Rev. Phytopath.* 28: 425-449; Duan et al. (1996) *Nature Biotechnology* 14: 494-498); wun1 and wun2, U.S. Pat. No. 5,428,148; win1 and win2 (Stanford et al. (1989) *Mol. Gen. Genet.* 215: 200-208); systemin (McGurl et al. (1992) *Science* 225: 1570-1573); WIP1 (Rohmeier et al. (1993) *Plant Mol. Biol.* 22: 783-792; Eckelkamp et al. (1993) *FEBS Letters* 323: 73-76); MPI gene (Corderok et al. (1994) *Plant J.* 6(2): 141-150); and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89: 245-254; Uknes et al. (1992) *Plant Cell* 4: 645-656; and Van Loon (1985) *Plant Mol. Virol.* 4: 111-116. See also WO 99/43819, herein incorporated by reference.

Of interest are promoters that are expressed locally at or near the site of pathogen infection. See, for example, Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977. See also, Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced pesticidal protein expression within a particular plant tissue. Tissue-preferred promoters include those discussed in Yamamoto et al. (1997) *Plant J.* 12(2)255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred or root-specific promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed roIC and roID root-inducing genes of *Agrobacterium rhizogenes* (see *Plant Science* (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and rolB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see U.S. Pat. No. 6,225,529, herein incorporated by reference). Gamma-zein and Glob-1 are endosperm-specific promoters. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also WO 00/12733, where seed-preferred promoters from end1 and end2 genes are disclosed; herein incorporated by reference. A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 99/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142; and 6,177,611; herein incorporated by reference.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional examples of suitable selectable marker genes include, but are not limited to, genes encoding resistance to chloramphenicol (Herrera Estrella et al. (1983) *EMBO J.* 2:987-992); methotrexate (Herrera Estrella et al. (1983) *Nature* 303:209-213; and Meijer et al. (1991) *Plant Mol. Biol.* 16:807-820); streptomycin (Jones et al. (1987) *Mol. Gen. Genet.* 210:86-91); spectinomycin (Bretagne-Sagnard et al. (1996) *Transgenic Res.* 5:131-137); bleomycin (Hille et al. (1990) *Plant Mol. Biol.* 7:171-176); sulfonamide (Guerineau et al. (1990) *Plant Mol. Biol.* 15:127-136); bromoxynil (Stålker et al. (1988) *Science* 242:419-423); glyphosate (Shaw et al. (1986) *Science* 233:478-481; and U.S. Pat. Nos. 7,709,702; and 7,462,481); phosphinothricin (DeBlock et al. (1987) *EMBO J.* 6:2513-2518). See generally, Yarranton (1992) *Curr. Opin. Biotech.* 3: 506-511; Christopherson et al. (1992) *Proc. Natl. Acad. Sci. USA* 89: 6314-6318; Yao et al. (1992) *Cell* 71: 63-72; Reznikoff (1992) *Mol. Microbiol.* 6: 2419-2422; Barkley et al. (1980) in *The Operon*, pp. 177-220; Hu et al. (1987) *Cell* 48: 555-566; Brown et al. (1987) *Cell* 49: 603-612; Figge et al. (1988) *Cell* 52: 713-722; Deuschle et al. (1989) *Proc. Natl. Acad. Sci. USA* 86: 5400-5404; Fuerst et al. (1989) *Proc. Natl. Acad. Sci. USA* 86: 2549-2553; Deuschle et al. (1990) *Science* 248: 480-483; Gossen (1993) Ph.D. Thesis, University of Heidelberg; Reines et al. (1993) *Proc. Natl. Acad. Sci. USA* 90: 1917-1921; Labow et al. (1990) *Mol. Cell. Biol.* 10: 3343-3356; Zambretti et al. (1992) *Proc. Natl. Acad. Sci. USA* 89: 3952-3956; Baim et al. (1991) *Proc. Natl. Acad. Sci. USA* 88: 5072-5076; Wyborski et al. (1991) *Nucleic Acids Res.* 19: 4647-4653; Hillenand-Wissman (1989) *Topics Mol. Struc. Biol.* 10: 143-162; Degenkolb et al. (1991) *Antimicrob. Agents Chemother.* 35: 1591-1595; Kleinschnidt et al. (1988) *Biochemistry* 27: 1094-1104; Bonin (1993) Ph.D. Thesis, University of Heidelberg; Gossen et al. (1992) *Proc. Natl. Acad. Sci. USA* 89: 5547-5551; Oliva et al. (1992) *Antimicrob. Agents Chemother.* 36: 913-919; Hlavka et al. (1985) *Handbook of Experimental Pharmacology*, Vol. 78 (Springer-Verlag, Berlin); and Gill et al. (1988) *Nature* 334: 721-724. Such disclosures are herein incorporated by reference.

The above list of selectable marker genes is not meant to be limiting. Any selectable marker gene can be used in the embodiments.

The methods of the embodiments involve introducing a polypeptide or polynucleotide into a plant. "Introducing" is intended to mean presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof. "Transient transformation" is intended to mean that a polynucleotide is introduced into the plant and does not integrate into the genome of the plant or a polypeptide is introduced into a plant.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) *Biotechniques* 4: 320-334), electroporation (Riggs et al. (1986) *Proc. Natl. Acad. Sci. USA* 83: 5602-5606), *Agrobacterium*-mediated transformation (U.S. Pat. Nos. 5,563,055 and 5,981,840), direct gene transfer (Paszkowski et al. (1984) *EMBO J.* 3: 2717-2722), and ballistic particle acceleration (see, for example, U.S. Pat. Nos. 4,945,050; 5,879,918; 5,886,244; and 5,932,782; Tomes et al. (1995) in *Plant Cell, Tissue, and Organ Culture: Fundamental Methods*, ed. Gamborg and Phillips (Springer-Verlag, Berlin); and McCabe et al. (1988) *Biotechnology* 6: 923-926); and Lec1 transformation (WO 00/28058). For potato transformation see Tu et al. (1998) *Plant Molecular Biology* 37: 829-838 and Chong et al. (2000) *Transgenic Research* 9: 71-78. Additional transformation procedures can be found in Weissinger et al. (1988) *Ann. Rev. Genet.* 22: 421-477; Sanford et al. (1987) *Particulate Science and Technology* 5: 27-37 (onion); Christou et al. (1988) *Plant Physiol.* 87: 671-674 (soybean); McCabe et al. (1988) *Bio/Technology* 6: 923-926 (soybean); Finer and McMullen (1991) *In Vitro Cell Dev. Biol.* 27P: 175-182 (soybean); Singh et al. (1998) *Theor. Appl. Genet.* 96: 319-324 (soybean); Datta et al. (1990) *Biotechnology* 8: 736-740 (rice); Klein et al. (1988) *Proc. Natl. Acad. Sci. USA* 85: 4305-4309 (maize); Klein et al. (1988) *Biotechnology* 6:559-563 (maize); U.S. Pat. Nos. 5,240,855; 5,322,783 and 5,324,646; Klein et al. (1988) *Plant Physiol.* 91: 440-444 (maize); Fromm et al. (1990) *Biotechnology* 8: 833-839 (maize); Hooykaas-Van Slogteren et al. (1984) *Nature* (London) 311: 763-764; U.S. Pat. No. 5,736,369 (cereals); Bytebier et al. (1987) *Proc. Natl. Acad. Sci. USA* 84: 5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9: 415-418 and Kaeppler et al. (1992) *Theor. Appl. Genet.* 84: 560-566 (whisker-mediated transformation); D'Halluin et al. (1992) *Plant Cell* 4: 1495-1505 (electroporation); Li et al. (1993) *Plant Cell Reports* 12: 250-255 and Christou and Ford (1995) *Annals of Botany* 75: 407-413 (rice); Osjoda et al. (1996) *Nature Biotechnology* 14: 745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the Cry toxin protein or variants and fragments thereof directly into the plant or the introduction of the Cry toxin transcript into the plant. Such methods include, for example, microinjection or particle bombardment. See, for example, Crossway et al. (1986) *Mol Gen. Genet.* 202: 179-185; Nomura et al. (1986) *Plant Sci.* 44: 53-58; Hepler et al. (1994) *Proc. Natl. Acad. Sci.* 91: 2176-2180 and Hush et al. (1994) *The Journal of Cell Science* 107: 775-784, all of which are herein incorporated by reference. Alternatively, the Cry toxin polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

The cells that have been transformed may be grown into plants in accordance with conventional ways. See, for example, McCormick et al. (1986) *Plant Cell Reports* 5: 81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired pesticidal protein. It is also recognized that such a viral polyprotein, comprising at least a portion of the amino acid sequence of a pesticidal protein of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367; and 5,316,931; herein incorporated by reference.

The embodiments further relate to plant-propagating material of a transformed plant of the embodiments including, but not limited to, seeds, tubers, corms, bulbs, leaves, and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. raga, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants, including, but not limited to: corn, alfalfa, sunflower, *Brassica* spp., soybean, cotton, safflower, peanut, sorghum, wheat, millet, tobacco, sugarcane, etc.

Turfgrasses include, but are not limited to: annual bluegrass (*Poa annua*); annual ryegrass (*Lolium multiflorum*); Canada bluegrass (*Poa compressa*); Chewings fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive etc. Leguminous plants include beans and peas. Beans include guar, locust bean, fenugreek, soybean, garden beans, cowpea, mung bean, lima bean, fava bean, lentils, chickpea, etc.

In certain embodiments, the nucleic acid sequences of the embodiments can be stacked with any combination of polynucleotide sequences of interest in order to create plants with a desired phenotype. For example, the polynucleotides of the embodiments may be stacked with any other polynucleotides encoding polypeptides having pesticidal and/or insecticidal activity, such as other Bt toxic proteins (described in U.S. Pat. Nos. 5,366,892; 5,747,450; 5,736,514; 5,723,756; 5,593,881; and Geiser et al. (1986) *Gene* 48:109), pentin (described in U.S. Pat. No. 5,981,722) and the like. The combinations generated can also include multiple copies of any one of the polynucleotides of interest. The polynucleotides of the embodiments can also be stacked with any other gene or combination of genes to produce plants with a variety of desired trait combinations including but not limited to traits desirable for animal feed such as high oil genes (e.g., U.S. Pat. No. 6,232,529); balanced amino acids (e.g. hordothionins (U.S. Pat. Nos. 5,990,389; 5,885,801; 5,885,802; and 5,703,049); barley high lysine (Williamson et al. (1987) *Eur. J. Biochem.* 165: 99-106; and WO 98/20122) and high methionine proteins (Pedersen et al. (1986) *J. Biol. Chem.* 261: 6279; Kirihara et al. (1988) *Gene* 71: 359; and Musumura et al. (1989) *Plant Mol. Biol.* 12: 123)); increased digestibility (e.g., modified storage proteins (U.S. Pat. No. 6,858,778); and thioredoxins (U.S. Pat. No. 7,009,087), the disclosures of which are herein incorporated by reference.

The polynucleotides of the embodiments can also be stacked with traits desirable for disease or herbicide resistance (e.g., fumonisin detoxification genes (U.S. Pat. No. 5,792,931); avirulence and disease resistance genes (Jones et al. (1994) *Science* 266:789; Martin et al. (1993) *Science* 262: 1432; and Mindrinos et al. (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene and GAT gene as disclosed in U.S. Pat. Nos. 7,709,702; and 7,462,481; and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE) and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170: 5837-5847) facilitate expression of polyhydroxyalkanoates (PHAs)), the disclosures of which are herein incorporated by reference. One could also combine the polynucleotides of the embodiments with polynucleotides providing agronomic traits such as male sterility (e.g., see U.S. Pat. No. 5,583,210), stalk strength, flowering time, or transformation technology traits such as cell cycle regulation or gene targeting (e.g. WO 99/61619; WO 00/17364; WO 99/25821), the disclosures of which are herein incorporated by reference.

In some embodiment the stacked trait may be a trait or event that has received regulatory approval which are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications isaaa.org/gmapprovaldatabase/default.asp, which can be accessed using the www prefix).

These stacked combinations can be created by any method including but not limited to cross breeding plants by any conventional or TOPCROSS® methodology, or genetic transformation. If the traits are stacked by genetically transforming the plants, the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

In some embodiments, the disclosed polynucleotide compositions can be introduced into the genome of a plant using genome editing technologies, or previously introduced polynucleotides in the genome of a plant may be edited using genome editing technologies. For example, the disclosed polynucleotides can be introduced into a desired location in the genome of a plant through the use of double-stranded break technologies such as TALENs, meganucleases, zinc finger nucleases, CRISPR-Cas, and the like. For example, the disclosed polynucleotides can be introduced into a desired location in a genome using a CRISPR-Cas system, for the purpose of site-specific insertion. The desired location in a plant genome can be any desired target site for insertion, such as a genomic region amenable for breeding or may be a target site located in a genomic window with an existing trait of interest. Existing traits of interest could be either an endogenous trait or a previously introduced trait.

In some embodiments, where the disclosed polynucleotide has previously been introduced into a genome, genome editing technologies may be used to alter or modify the introduced polynucleotide sequence. Site specific modifications that can be introduced into the disclosed polynucleotide compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. Such technologies can be used to modify the previously introduced polynucleotide through the insertion, deletion or substitution of nucleotides within the introduced polynucleotide. Alternatively, double-stranded break technologies can be used to add additional nucleotide sequences to the introduced polynucleotide. Additional sequences that may be added include, additional expression elements, such as enhancer and promoter sequences. In another embodiment, genome editing technologies may be used to position additional insecticidally-active proteins in close proximity to the disclosed polynucleotide compositions disclosed herein within the genome of a plant, in order to generate molecular stacks of insecticidally-active proteins.

An "altered target site," "altered target sequence." "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

Compositions of the embodiments find use in protecting plants, seeds, and plant products in a variety of ways. For example, the compositions can be used in a method that involves placing an effective amount of the pesticidal composition in the environment of the pest by a procedure selected from the group consisting of spraying, dusting, broadcasting, or seed coating.

Before plant propagation material (fruit, tuber, bulb, corm, grains, seed), but especially seed, is sold as a commercial product, it is customarily treated with a protectant coating comprising herbicides, insecticides, fungicides, bactericides, nematicides, molluscicides, or mixtures of several of these preparations, if desired together with further carriers, surfactants, or application-promoting adjuvants customarily employed in the art of formulation to provide protection against damage caused by bacterial, fungal, or animal pests. In order to treat the seed, the protectant coating may be applied to the seeds either by impregnating the tubers or grains with a liquid formulation or by coating them with a combined wet or dry formulation. In addition, in special cases, other methods of application to plants are possible, e.g., treatment directed at the buds or the fruit.

The plant seed of the embodiments comprising a nucleotide sequence encoding a pesticidal protein of the embodiments may be treated with a seed protectant coating comprising a seed treatment compound, such as, for example, captan, carboxin, thiram, methalaxyl, pirimiphos-methyl, and others that are commonly used in seed treatment. In one embodiment, a seed protectant coating comprising a pesticidal composition of the embodiments is used alone or in combination with one of the seed protectant coatings customarily used in seed treatment.

It is recognized that the genes encoding the pesticidal proteins can be used to transform insect pathogenic organisms. Such organisms include baculoviruses, fungi, protozoa, bacteria, and nematodes.

A gene encoding a pesticidal protein of the embodiments may be introduced via a suitable vector into a microbial host, and said host applied to the environment, or to plants or animals. The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid, or mitochondrial DNA), converted into an autonomous replicon, or transiently expressed (e.g., transfected mRNA).

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*, fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum*, Agrobacteria, *Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Of particular interest are the pigmented microorganisms.

A number of ways are available for introducing a gene expressing the pesticidal protein into the microorganism host under conditions that allow for stable maintenance and expression of the gene. For example, expression cassettes can be constructed which include the nucleotide constructs of interest operably linked with the transcriptional and translational regulatory signals for expression of the nucleotide constructs, and a nucleotide sequence homologous with a sequence in the host organism, whereby integration will occur, and/or a replication system that is functional in the host, whereby integration or stable maintenance will occur.

Transcriptional and translational regulatory signals include, but are not limited to, promoters, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook; Maniatis et al. (Cold Spring Harbor Laboratory Press, Cold Spring Harbor, N.Y.); Davis et al., eds. (1980) *Advanced Bacterial Genetics* (Cold Spring Harbor Laboratory Press, Cold Spring Harbor, N.Y.) and the references cited therein.

Suitable host cells, where the pesticidal protein-containing cells will be treated to prolong the activity of the pesticidal proteins in the cell when the treated cell is applied to the environment of the target pest(s), may include either prokaryotes or eukaryotes, normally being limited to those cells that do not produce substances toxic to higher organisms, such as mammals. However, organisms that produce substances toxic to higher organisms could be used, where the toxin is unstable or the level of application sufficiently low as to avoid any possibility of toxicity to a mammalian host. As hosts, of particular interest will be the prokaryotes and the lower eukaryotes, such as fungi. Illustrative prokaryotes, both Gram-negative and gram-positive, include Enterobacteriaceae, such as *Escherichia, Erwinia, Shigella, Salmonella*, and *Proteus*; Bacillaceae; Rhizobiaceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae and Nitrobacteraceae. Among eukaryotes are fungi, such as *Phycomycetes* and *Ascomycetes*, which includes yeast, such as *Saccharomyces* and *Schizosaccharomyces*; and Basidiomycetes yeast, such as *Rhodotorula, Aureobasidium, Sporobolomyces*, and the like.

Characteristics of particular interest in selecting a host cell for purposes of pesticidal protein production include ease of introducing the pesticidal protein gene into the host, availability of expression systems, efficiency of expression, stability of the protein in the host, and the presence of auxiliary genetic capabilities. Characteristics of interest for use as a pesticide microcapsule include protective qualities for the pesticide, such as thick cell walls, pigmentation, and intracellular packaging or formation of inclusion bodies; leaf affinity; lack of mammalian toxicity; attractiveness to pests for ingestion; ease of killing and fixing without damage to the toxin; and the like. Other considerations include ease of formulation and handling, economics, storage stability, and the like.

Host organisms of particular interest include yeast, such as *Rhodotorula* spp., *Aureobasidium* spp., *Saccharomyces* spp. (such as *S. cerevisiae*), Sporobolomyces spp., phylloplane organisms such as *Pseudomonas* spp. (such as *P. aeruginosa, P. fluorescens*), *Erwinia* spp., and *Flavobacterium* spp., and other such organisms, including Bt, *E. coli, Bacillus subtilis*, and the like.

Genes encoding the pesticidal proteins of the embodiments can be introduced into microorganisms that multiply on plants (epiphytes) to deliver pesticidal proteins to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the pesticidal proteins of the embodiments can be introduced into a root-colonizing *Bacillus cereus* by standard methods known in the art.

Genes encoding pesticidal proteins can be introduced, for example, into the root-colonizing *Bacillus* by means of electrotransformation. Specifically, genes encoding the pesticidal proteins can be cloned into a shuttle vector, for example, pHT3101 (Lerecius et al. (1989) *FEMS Microbiol. Letts.* 60: 211-218. The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211-218).

Expression systems can be designed so that pesticidal proteins are secreted outside the cytoplasm of gram-negative bacteria, such as *E. coli*, for example. Advantages of having pesticidal proteins secreted are: (1) avoidance of potential cytotoxic effects of the pesticidal protein expressed; and (2) improvement in the efficiency of purification of the pesticidal protein, including, but not limited to, increased efficiency in the recovery and purification of the protein per volume cell broth and decreased time and/or costs of recovery and purification per unit protein.

Pesticidal proteins can be made to be secreted in *E. coli*, for example, by fusing an appropriate *E. coli* signal peptide to the amino-terminal end of the pesticidal protein. Signal peptides recognized by *E. coli* can be found in proteins already known to be secreted in *E. coli*, for example the OmpA protein (Ghrayeb et al. (1984) *EMBO J*, 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud et al. (1987) *Meth. Enzymol.* 153: 492).

Pesticidal proteins of the embodiments can be fermented in a bacterial host and the resulting bacteria processed and used as a microbial spray in the same manner that Bt strains have been used as insecticidal sprays. In the case of a pesticidal protein(s) that is secreted from *Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins. Any suitable microorganism can be used for this purpose. *Pseudomonas* has been used to express Bt toxins as encapsulated proteins and the resulting cells processed and sprayed as an insecticide (Gaertner et al. (1993), in: *Advanced Engineered Pesticides*, ed. Kim).

Alternatively, the pesticidal proteins are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example EP0192319, and the references cited therein.

In the embodiments, a transformed microorganism (which includes whole organisms, cells, spore(s), pesticidal protein(s), pesticidal component(s), pest-impacting component(s), mutant(s), living or dead cells and cell components, including mixtures of living and dead cells and cell components, and including broken cells and cell components) or an isolated pesticidal protein can be formulated with an acceptable carrier into a pesticidal composition(s) that is, for example, a suspension, a solution, an emulsion, a dusting powder, a dispersible granule or pellet, a wettable powder, and an emulsifiable concentrate, an aerosol or spray, an impregnated granule, an adjuvant, a coatable paste, a colloid, and also encapsulations in, for example, polymer substances. Such formulated compositions may be prepared by such conventional means as desiccation, lyophilization, homogenization, extraction, filtration, centrifugation, sedimentation, or concentration of a culture of cells comprising the polypeptide.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaricides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the embodiments are normally applied in the form of compositions and can be applied to the crop area, plant, or seed to be treated. For example, the compositions of the embodiments may be applied to grain in preparation for or during storage in a grain bin or silo, etc. The compositions of the embodiments may be applied simultaneously or in succession with other compounds. Methods of applying an active ingredient of the embodiments or an agrochemical composition of the embodiments that contains at least one of the pesticidal proteins produced by the bacterial strains of the embodiments include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the embodiments can be in a suitable form for direct application or as a concentrate of primary composition that requires dilution with a suitable quantity of water or other diluent before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant. These compositions will be administered at the labeled rate for the commercial product, for example, about 0.01 lb-5.0 lb. per acre when in dry form and at about 0.01 pts.-10 pts. per acre when in liquid form.

In a further embodiment, the compositions, as well as the transformed microorganisms and pesticidal proteins of the embodiments, can be treated prior to formulation to prolong the pesticidal activity when applied to the environment of a target pest as long as the pretreatment is not deleterious to the pesticidal activity. Such treatment can be by chemical and/or physical means as long as the treatment does not deleteriously affect the properties of the composition(s). Examples of chemical reagents include but are not limited to halogenating agents; aldehydes such as formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W. H. Freeman and Co.).

In other embodiments, it may be advantageous to treat the Cry toxin polypeptides with a protease, for example trypsin, to activate the protein prior to application of a pesticidal protein composition of the embodiments to the environment of the target pest. Methods for the activation of protoxin by a serine protease are well known in the art. See, for example, Cooksey (1968) *Biochem. J.* 6:445-454 and Carroll and Ellar (1989) *Biochem. J.* 261:99-105, the teachings of which are herein incorporated by reference. For example, a suitable activation protocol includes, but is not limited to, combining a polypeptide to be activated, for example a purified novel Cry polypeptide (e.g., having the amino acid sequence set forth in SEQ ID NO: 4 or SEQ ID NO: 8, and trypsin at a 1/100 weight ratio of protein/trypsin in 20 nM NaHCO$_3$, pH 8 and digesting the sample at 36° C. for 3 hours.

The compositions (including the transformed microorganisms and pesticidal proteins of the embodiments) can be applied to the environment of an insect pest by, for example, spraying, atomizing, dusting, scattering, coating or pouring, introducing into or on the soil, introducing into irrigation water, by seed treatment or general application or dusting at the time when the pest has begun to appear or before the appearance of pests as a protective measure. For example, the pesticidal protein and/or transformed microorganisms of the embodiments may be mixed with grain to protect the grain during storage. It is generally important to obtain good control of pests in the early stages of plant growth, as this is the time when the plant can be most severely damaged. The compositions of the embodiments can conveniently contain another insecticide if this is thought necessary. In one embodiment, the composition is applied directly to the soil, at a time of planting, in granular form of a composition of a carrier and dead cells of a *Bacillus* strain or transformed microorganism of the embodiments. Another embodiment is a granular form of a composition comprising an agrochemical such as, for example, an herbicide, an insecticide, a fertilizer, an inert carrier, and dead cells of a *Bacillus* strain or transformed microorganism of the embodiments.

Those skilled in the art will recognize that not all compounds are equally effective against all pests. Compounds of the embodiments display activity against insect pests, which may include economically important agronomic, forest, greenhouse, nursery, ornamentals, food and fiber, public and animal health, domestic and commercial structure, household, and stored product pests. Insect pests include insects selected from the orders *Coleoptera, Diptera, Hymenoptera, Lepidoptera, Mallophaga, Homoptera, Hemiptera, Orthoptera, Thysanoptera, Dermaptera, Isoptera, Anoplura, Siphonaptera, Trichoptera*, etc., particularly *Coleoptera* and *Lepidoptera*.

Insects of the order *Lepidoptera* include, but are not limited to, armyworms, cutworms, loopers, and heliothines in the family Noctuidae: *Agrotis ipsilon* Hufnagel (black cutworm); *A. orthogonia* Morrison (western cutworm); *A. segetum* Denis & Schiffermüller (turnip moth); *A. subterranea* Fabricius (granulate cutworm); *Alabama argillacea* Hübner (cotton leaf worm); *Anticarsia gemmatalis* Hübner (velvetbean caterpillar); *Athetis mindara* Barnes and McDunnough (rough skinned cutworm); *Earias insulana* Boisduval (spiny bollworm); *E. vittella* Fabricius (spotted bollworm); Egira (*Xylomyges*) *curialis* Grote (citrus cutworm); *Euxoa messoria* Harris (darksided cutworm); *Helicoverpa armigera* Hübner (American bollworm); *H. zea* Boddie (corn earworm or cotton bollworm); *Heliothis virescens* Fabricius (tobacco budworm); *Hypena scabra* Fabricius (green cloverworm); *Mamestra configurata* Walker (bertha armyworm); *M. brassicae* Linnaeus (cabbage moth); *Melanchra picta* Harris (zebra caterpillar); *Pseudaletia unipuncta* Haworth (armyworm); *Pseudoplusia includens* Walker (soybean looper); *Richia albicosta* Smith (Western bean cutworm); *Spodoptera frugiperda* J E Smith (fall armyworm); *S. exigua* Hübner (beet armyworm); *S. litura* Fabricius (tobacco cutworm, cluster caterpillar); *Trichoplusia ni* Hübner (cabbage looper); borers, casebearers, webworms, coneworms, and skeletonizers from the families Pyralidae and Crambidae such as *Achroia grisella* Fabricius (lesser wax moth); *Amyelois transitella* Walker (naval orangeworm); *Anagasta kuehniella* Zeller (Mediterranean flour moth); *Cadra cautella* Walker (almond moth); *Chilo partellus* Swinhoe (spotted stalk borer); *C. suppressalis* Walker (striped stem/rice borer); *C. terrenellus* Pagenstecher (sugarcane stemp borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Elasmopalpus lignosellus* Zeller (lesser cornstalk borer); *Eoreuma loftini* Dyar (Mexican rice borer); *Ephestia elutella* Hübner (tobacco (cacao) moth); *Galleria mellonella* Linnaeus (greater wax moth); *Hedylepta accepta* Butler (sugarcane leaf roller); *Herpetogramma licarsisalis* Walker (sod webworm); *Homoeosoma electellum* Hulst (sunflower moth); *Loxostege sticticalis* Linnaeus (beet webworm); *Maruca testulalis* Geyer (bean pod borer); *Orthaga thyrisalis* Walker (tea tree web moth); *Ostrinia nubilalis* Hübner (European corn borer); *Plodia interpunctella* Hübner (Indian meal moth); *Scirpophaga incertulas* Walker (yellow stem borer); *Udea rubigalis* Guenée (celery leaftier); and leafrollers, budworms, seed worms, and fruit worms in the family Tortricidae *Acleris gloverana* Walsingham (Western blackheaded budworm); *A. variana* Fernald (Eastern blackheaded budworm); *Adoxophyes orana* Fischer von Rösslerstamm (summer fruit tortrix moth); *Archips* spp. including *A. argyrospila* Walker (fruit tree leaf roller) and *A. rosana* Linnaeus (European leaf roller); *Argyrotaenia* spp.; *Bonagota salubricola* Meyrick (Brazilian apple leaf roller); *Choristoneura* spp.; *Cochylis hospes* Walsingham (banded sunflower moth); *Cydia latiferreana* Walsingham (filbertworm); *C. pomonella* Linnaeus (codling moth); *Endopiza viteana* Clemens (grape berry moth); *Eupoecilia ambiguella* Hübner (vine moth); *Grapholita molesta* Busck (oriental fruit moth); *Lobesia botrana* Denis & Schiffermüller (European grape vine moth); *Platynota flavedana* Clemens (variegated leafroller); *P. stultana* Walsingham (omnivorous leafroller); *Spilonota ocellana* Denis & Schiffermüller (eyespotted bud moth); and *Suleima helianthana* Riley (sunflower bud moth).

Selected other agronomic pests in the order *Lepidoptera* include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Silkmoth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth); *Ennomos subsignaria* Hübner (elm spanworm); *Erannis tiliaria* Harris (linden looper); *Erechthias flavistriata* Walsingham (sugarcane bud moth); *Euproctis chrysorrhoea* Linnaeus (browntail moth); *Harrisina americana* Guérin-Méneville (grapeleaf skeletonizer); *Heliothis subflexa* Guenée; *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Malacosoma* spp.; *Manduca quinquemaculata* Haworth (five spotted hawk moth, tomato hornworm); *M. sexta* Haworth (tomato hornworm, tobacco hornworm); *Operophtera brumata* Linnaeus (winter moth); *Orgyia* spp.; *Paleacrita vernata* Peck (spring cankerworm); *Papilio cresphontes* Cramer (giant swallowtail, orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); Pontia protodice Boisduval & Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer) and *Yponomeuta padella* Linnaeus (ermine moth).

Of interest are larvae and adults of the order *Coleoptera* including weevils from the families Anthribidae, Bruchidae, and Curculionidae including, but not limited to: *Anthonomus grandis* Boheman (boll weevil); *Cylindrocopturus adspersus* LeConte (sunflower stem weevil); *Diaprepes abbreviatus* Linnaeus (Diaprepes root weevil); *Hypera punctata* Fabricius (clover leaf weevil); *Lissorhoptrus oryzophilus* Kuschel (rice water weevil); *Metamasius hemipterus hemipterus* Linnaeus (West Indian cane weevil); *M. hemipterus sericeus* Olivier (silky cane weevil); *Sitophilus granarius* Linnaeus (granary weevil); *S. oryzae* Linnaeus (rice weevil); *Smicronyx fulvus* LeConte (red sunflower seed weevil); *S. sordidus* LeConte (gray sunflower seed weevil); *Sphenophorus maidis* Chittenden (maize billbug); *Rhabdoscelus obscurus* Boisduval (New Guinea sugarcane weevil); flea beetles, cucumber beetles, rootworms, leaf beetles, potato beetles, and leafminers in the family Chrysomelidae including, but not limited to: *Chaetocnema ectypa* Horn (desert corn flea beetle); *C. pulicaria* Melsheimer (corn flea beetle); *Colaspis brunnea* Fabricius (grape colaspis); *Diabrotica barberi* Smith & Lawrence (northern corn rootworm); *D. undecimpunctata howardi* Barber (southern corn rootworm); *D. virgifera virgifera* LeConte (western corn rootworm); *Leptinotarsa decemlineata* Say (Colorado potato beetle); *Oulema melanopus* Linnaeus (cereal leaf beetle); *Phyllotreta cruciferae* Goeze (corn flea beetle); *Zygogramma exclamationis* Fabricius (sunflower beetle); beetles from the family Coccinellidae including, but not limited to: *Epilachna varivestis* Mulsant (Mexican bean beetle); chafers and other beetles from the family Scarabaeidae including, but not limited to: *Antitrogus parvulus* Britton (Childers cane grub); *Cyclocephala borealis* Arrow (northern masked chafer, white grub); *C. immaculata* Olivier (southern masked chafer, white grub); *Dermolepida albohirtum* Waterhouse (Greyback cane beetle); *Euetheola humilis rugiceps* LeConte (sugarcane beetle); *Lepidiota frenchi* Blackburn (French's cane grub); *Tomarus gibbosus* De Geer (carrot beetle); *T. subtropicus* Blatchley (sugarcane grub); *Phyllophaga crinita* Burmeister (white grub); *P. latifrons* LeConte (June beetle); *Popillia japonica* Newman (Japanese beetle); *Rhizotrogus majalis* Razoumowsky (European chafer); carpet beetles from the family Dermestidae; wireworms from the family Elateridae, *Eleodes* spp., *Melanotus* spp. including *M. communis* Gyllenhal (wireworm); *Conoderus* spp.; *Limonius* spp.; *Agriotes* spp.; *Ctenicera* spp.; *Aeolus* spp.; bark beetles from the family Scolytidae; beetles from the family Tenebrionidae; beetles from the family Cerambycidae such as, but not limited to, *Migdolus fryanus* Westwood (longhorn beetle); and beetles from the Buprestidae family including, but not limited to, *Aphanisticus cochinchinae seminulum* Obenberger (leaf-mining buprestid beetle).

Adults and immatures of the order *Diptera* are of interest, including leafminers *Agromyza parvicornis* Loew (corn blotch leafminer); midges including, but not limited to: *Contarinia sorghicola* Coquillett (sorghum midge); *Mayetiola destructor* Say (Hessian fly); *Neolasioptera murtfeldtiana* Felt, (sunflower seed midge); *Sitodiplosis mosellana* Géhin (wheat midge); fruit flies (Tephritidae), *Oscinella frit* Linnaeus (frit flies); maggots including, but not limited to: *Delia* spp. including *Delia platura* Meigen (seedcorn maggot); *D. coarctata* Fallen (wheat bulb fly); *Fannia canicularis* Linnaeus, *F. femoralis* Stein (lesser house flies); *Meromyza americana* Fitch (wheat stem maggot); *Musca domestica* Linnaeus (house flies); *Stomoxys calcitrans* Linnaeus (stable flies)); face flies, horn flies, blow flies, *Chrysomya* spp.; *Phormia* spp.; and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds); and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are those of the order *Hemiptera* such as, but not limited to, the following families: Adelgidae, Aleyrodidae, Aphididae, Asterolecaniidae, Cercopidae, Cicadellidae, Cicadidae, Cixiidae, Coccidae, Coreidae, Dactylopiidae, Delphacidae, Diaspididae, Eriococcidae, Flatidae, Fulgoridae, Issidae, Lygaeidae, Margarodidae, Membracidae, Miridae, Ortheziidae, Pentatomidae, Phoenicococcidae, Phylloxeridae, Pseudococcidae, Psyllidae, Pyrrhocoridae and Tingidae.

Agronomically important members from the order *Hemiptera* include, but are not limited to: *Acrosternum hilare* Say (green stink bug); *Acyrthisiphon pisum* Harris (pea aphid); *Adelges* spp. (adelgids); *Adelphocoris rapidus* Say (rapid plant bug); *Anasa tristis* De Geer (squash bug); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacaspis tegalensis* Zehntner (sugarcane scale); *Aulacorthum solani* Kaltenbach (foxglove aphid); *Bemisia tabaci* Gennadius (tobacco whitefly, sweetpotato whitefly); *B. argentifolii* Bellows & Perring (silverleaf whitefly); *Blissus leucopterus leucopterus* Say (chinch bug); *Blostomatidae* spp.; *Brevicoryne brassicae* Linnaeus (cabbage aphid); *Cacopsylla pyricola* Foerster (pear psylla); *Calocoris norvegicus* Gmelin (potato capsid bug); *Chaetosiphon fragaefolii* Cockerell (strawberry aphid); *Cimicidae* spp.; *Coreidae* spp.; *Corythuca gossypii* Fabricius (cotton lace bug); *Cyrtopeltis modesta* Distant (tomato bug); *C. notatus* Distant (suckfly); *Deois flavopicta* Stål (spittlebug); *Dialeurodes citri* Ashmead (citrus whitefly); *Diaphnocoris chlorionis* Say (honeylocust plant bug); *Diuraphis noxia* Kurdjumov/Mordvilko (Russian wheat aphid); *Duplachionaspis divergens* Green (armored scale); *Dysaphis plantaginea* Paaserini (rosy apple aphid); *Dysdercus suturellus* Herrich-Schäffer (cotton stainer); *Dysmicoccus boninsis* Kuwana (gray sugarcane mealybug); *Empoasca fabae* Harris (potato leafhopper); *Eriosoma lanigerum* Hausmann (woolly apple aphid); *Erythroneoura* spp. (grape leafhoppers); *Eumetopina flavipes* Muir (Island sugarcane planthopper); *Eurygaster* spp.; *Euschistus servus* Say (brown stink bug); *E. variolarius* Palisot de Beauvois (one-spotted stink bug); Graptostethus spp. (complex of seed bugs); and *Hyalopterus pruni* Geoffroy (mealy plum aphid); *Icerya purchasi* Maskell (cottony cushion scale); *Labopidicola allii* Knight (onion plant bug); *Laodelphax striatellus* Fallen (smaller brown planthopper); *Leptoglossus corculus* Say (leaf-footed pine seed bug); *Leptodictya tabida* Herrich-Schaeffer (sugarcane lace bug); *Lipaphis erysimi* Kaltenbach (turnip aphid); *Lygocoris pabulinus* Linnaeus (common green capsid); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Macrosiphum euphorbiae* Thomas (potato aphid); *Macrosteles quadrilineatus* Forbes (aster leafhopper); *Magicicada septendecim* Linnaeus (periodical cicada); *Mahanarva fimbriolata* Stål (sugarcane spittlebug); *Melanaphis sacchari* Zehntner (sugarcane aphid); *Melanaspis glomerata* Green (black scale); *Metopolophium dirhodum* Walker (rose grain aphid); *Myzus persicae* Sulzer (peach-potato aphid, green peach aphid); *Nasonovia ribisnigri* Mosley (lettuce aphid); *Nephotettix cinticeps* Uhler (green leafhopper); *N. nigropictus* Stål (rice leafhopper); *Nezara viridula* Linnaeus (southern green stink bug); *Nilaparvata lugens* Stål (brown planthopper); *Nysius ericae* Schilling (false chinch bug); *Nysius raphanus* Howard (false chinch bug); *Oebalus pugnax* Fabricius (rice stink bug); *Oncopeltus fasciatus* Dallas (large milkweed bug); *Orthops campestris* Linnaeus; *Pemphigus* spp. (root aphids and gall aphids); *Peregrinus maidis* Ashmead (corn planthopper); *Perkinsiella saccharicida* Kirkaldy (sugarcane delphacid); *Phylloxera devastatrix* Pergande (pecan *phylloxera*); *Planococcus citri* Risso (citrus mealybug); *Plesiocoris rugicollis* Fallen (apple capsid); *Poecilocapsus lineatus* Fabricius (four-lined plant bug); *Pseudatomoscelis seriatus* Reuter (cotton fleahopper); *Pseudococcus* spp. (other mealybug complex); *Pulvinaria elongata* Newstead (cottony grass scale); *Pyrilla perpusilla* Walker (sugarcane leafhopper); *Pyrrhocoridae* spp.; *Quadraspidiotus perniciosus* Comstock (San Jose scale); *Reduviidae* spp.; *Rhopalosiphum maidis* Fitch (corn leaf aphid); *R. padi* Linnaeus (bird cherry-oat aphid); *Saccharicoccus sacchari* Cockerell (pink sugarcane mealybug); *Schizaphis graminum* Rondani (greenbug); *Sipha flava* Forbes (yellow sugarcane aphid); *Sitobion avenae* Fabricius (English grain aphid); *Sogatella furcifera* Horvath (white-backed planthopper); *Sogatodes oryzicola* Muir (rice delphacid); *Spanagonicus albofasciatus* Reuter (whitemarked fleahopper); *Therioaphis maculata* Buckton (spotted alfalfa aphid); *Tinidae* spp.; *Toxoptera aurantii* Boyer de Fonscolombe (black citrus aphid); and *T. citricida* Kirkaldy (brown citrus aphid); *Trialeurodes abutiloneus* (bandedwinged whitefly) and *T. vaporariorum* Westwood (greenhouse whitefly); *Trioza diospyri* Ashmead (persimmon psylla); and *Typhlocyba pomaria* McAtee (white apple leafhopper).

Also included are adults and larvae of the order Acari (mites) such as *Aceria tosichella* Keifer (wheat curl mite); *Panonychus ulmi* Koch (European red mite); *Petrobia latens* Wüller (brown wheat mite); *Steneotarsonemus bancrofti* Michael (sugarcane stalk mite); spider mites and red mites in the family Tetranychidae, *Oligonychus grypus* Baker & Pritchard, *O. indicus* Hirst (sugarcane leaf mite), *O. pratensis* Banks (Banks grass mite), *O. stickneyi* McGregor (sugarcane spider mite); *Tetranychus urticae* Koch (two spotted spider mite); *T. mcdanieli* McGregor (McDaniel mite); *T. cinnabarinus* Boisduval (carmine spider mite); *T. turkestani* Ugarov & Nikolski (strawberry spider mite), flat mites in the family Tenuipalpidae, *Brevipalpus lewisi* McGregor (citrus flat mite); rust and bud mites in the family Eriophyidae and other foliar feeding mites and mites important in human and animal health, i.e. dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick); and scab and itch mites in the families Psoroptidae, Pyemotidae, and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles recluse* Gertsch & Mulaik (brown recluse spider); and the *Latrodectus mactans* Fabricius (black widow spider); and centipedes in the order Scutigeromorpha such as *Scutigera coleoptrata* Linnaeus (house centipede). In addition, insect pests of the order Isoptera are of interest, including those of the termitidae family, such as, but not limited to, *Cylindrotermes nordenskioeldi* Holmgren and *Pseudacanthotermes militaris* Hagen (sugarcane termite). Insects of the order Thysanoptera are also of interest, including but not limited to thrips, such as *Stenchaetothrips minutus* van Deventer (sugarcane thrips).

Insect pests may be tested for pesticidal activity of compositions of the embodiments in early developmental stages, e.g., as larvae or other immature forms. The insects may be reared in total darkness at from about 20° C. to about 30° C. and from about 30% to about 70% relative humidity. Bioassays may be performed as described in Czapla and Lang (1990) *J. Econ. Entomol.* 83(6): 2480-2485. Methods of rearing insect larvae and performing bioassays are well known to one of ordinary skill in the art.

A wide variety of bioassay techniques are known to one skilled in the art. General procedures include addition of the experimental compound or organism to the diet source in an enclosed container. Pesticidal activity can be measured by, but is not limited to, changes in mortality, weight loss, attraction, repellency and other behavioral and physical changes after feeding and exposure for an appropriate length of time. Bioassays described herein can be used with any feeding insect pest in the larval or adult stage.

The following examples are presented by way of illustration, not by way of limitation.

EXPERIMENTALS

Example 1—Gene Identification and *E. coli* Expression

Polynucleotides encoding insecticidal proteins were obtained from a screen of *Bacillus thuringiensis* isolates from an internal DuPont proprietary collection of *Bacillus thuringiensis* isolates. Table 1 shows the insecticidal protein identifier, the sequence identifier number for the polynucleotides encoding the insecticidal proteins, the sequence identifier number for the insecticidal proteins, and the internal strain designations.

TABLE 1

| Identifier | polynucleotide | polypeptide | Strain ID |
| --- | --- | --- | --- |
| MP032 | SEQ ID NO: 1 | SEQ ID NO: 2 | DP606 |
| MP049 | SEQ ID NO: 3 | SEQ ID NO: 4 | DP606 |
| MP051 | SEQ ID NO: 5 | SEQ ID NO: 6 | BD2101 |
| MP066 | SEQ ID NO: 7 | SEQ ID NO: 8 | DP606 |
| MP068 | SEQ ID NO: 9 | SEQ ID NO: 10 | DP606 |
| MP070 | SEQ ID NO: 11 | SEQ ID NO: 12 | DP606 |
| MP091S | SEQ ID NO: 13 | SEQ ID NO: 14 | DP2561 |
| MP109S | SEQ ID NO: 15 | SEQ ID NO: 16 | DP1644 |
| MP114 | SEQ ID NO: 17 | SEQ ID NO: 18 | BD574 |
| MP121 | SEQ ID NO: 19 | SEQ ID NO: 20 | DP432 |
| MP134S | SEQ ID NO: 21 | SEQ ID NO: 22 | BD574 |
| MP183S | SEQ ID NO: 23 | SEQ ID NO: 24 | DP1247 |
| MP185S | SEQ ID NO: 25 | SEQ ID NO: 26 | DP1247 |
| MP186S | SEQ ID NO: 27 | SEQ ID NO: 28 | DP1247 |
| MP195S | SEQ ID NO: 29 | SEQ ID NO: 30 | DP1247 |
| MP197S | SEQ ID NO: 31 | SEQ ID NO: 32 | DP1247 |
| MP208S | SEQ ID NO: 33 | SEQ ID NO: 34 | DP3219 |
| MP209S | SEQ ID NO: 35 | SEQ ID NO: 36 | DP3219 |
| MP212S | SEQ ID NO: 37 | SEQ ID NO: 38 | DP511 |
| MP214S | SEQ ID NO: 39 | SEQ ID NO: 40 | DP41 |
| MP217S | SEQ ID NO: 41 | SEQ ID NO: 42 | DP3219 |
| MP222S | SEQ ID NO: 43 | SEQ ID NO: 44 | DP3219 |
| MP234S | SEQ ID NO: 45 | SEQ ID NO: 46 | DP3219 |
| MP235S | SEQ ID NO: 47 | SEQ ID NO: 48 | DP3219 |
| MP237S | SEQ ID NO: 49 | SEQ ID NO: 50 | DP3219 |
| MP242S | SEQ ID NO: 51 | SEQ ID NO: 52 | DP1415 |
| MP243 | SEQ ID NO: 53 | SEQ ID NO: 54 | DP1415 |
| MP248 | SEQ ID NO: 55 | SEQ ID NO: 56 | DP227 |
| MP249S | SEQ ID NO: 57 | SEQ ID NO: 58 | DP371 |
| MP251M | SEQ ID NO: 59 | SEQ ID NO: 60 | DP616 |
| MP252S | SEQ ID NO: 61 | SEQ ID NO: 62 | DP552 |
| MP253 | SEQ ID NO: 63 | SEQ ID NO: 64 | DP264 |
| MP259S | SEQ ID NO: 65 | SEQ ID NO: 66 | DP552 |
| MP287S | SEQ ID NO: 67 | SEQ ID NO: 68 | MG5517 |
| MP288S | SEQ ID NO: 69 | SEQ ID NO: 70 | DP1415 |
| MP295S | SEQ ID NO: 71 | SEQ ID NO: 72 | DP940 |
| MP296S | SEQ ID NO: 73 | SEQ ID NO: 74 | DP760 |
| MP297S | SEQ ID NO: 75 | SEQ ID NO: 76 | DP760 |
| MP300S | SEQ ID NO: 77 | SEQ ID NO: 78 | DP1180 |
| MP304S | SEQ ID NO: 79 | SEQ ID NO: 80 | DP2087 |
| MP306S | SEQ ID NO: 81 | SEQ ID NO: 82 | DP59 |
| MP310S | SEQ ID NO: 83 | SEQ ID NO: 84 | BD380 |
| MP312S | SEQ ID NO: 85 | SEQ ID NO: 86 | DP996 |
| MP314S | SEQ ID NO: 87 | SEQ ID NO: 88 | DP736 |
| MP319S | SEQ ID NO: 89 | SEQ ID NO: 90 | DP760 |
| MP325S | SEQ ID NO: 91 | SEQ ID NO: 92 | DP2079 |
| MP326S | SEQ ID NO: 93 | SEQ ID NO: 94 | DP2079 |
| MP327S | SEQ ID NO: 95 | SEQ ID NO: 96 | DP2073 |
| MP334S | SEQ ID NO: 97 | SEQ ID NO: 98 | DP2079 |
| MP337S | SEQ ID NO: 99 | SEQ ID NO: 100 | DP2079 |
| MP342S | SEQ ID NO: 101 | SEQ ID NO: 102 | DP932 |
| MP356S | SEQ ID NO: 103 | SEQ ID NO: 104 | DP2093 |
| MP359S | SEQ ID NO: 105 | SEQ ID NO: 106 | DP1134 |
| MP360S | SEQ ID NO: 107 | SEQ ID NO: 108 | AM858 |
| MP437S | SEQ ID NO: 109 | SEQ ID NO: 110 | AM2753 |
| MP451S | SEQ ID NO: 111 | SEQ ID NO: 112 | AM1080 |
| MP452S | SEQ ID NO: 113 | SEQ ID NO: 114 | AM1096-2 |
| MP466S | SEQ ID NO: 115 | SEQ ID NO: 116 | DP2611 |
| MP468S | SEQ ID NO: 117 | SEQ ID NO: 118 | DP1659 |
| MP476S | SEQ ID NO: 119 | SEQ ID NO: 120 | AM2549 |
| MP482S | SEQ ID NO: 121 | SEQ ID NO: 122 | AM1118 |
| MP522S | SEQ ID NO: 123 | SEQ ID NO: 124 | JAPH0545 |
| MP529S | SEQ ID NO: 125 | SEQ ID NO: 126 | BD1553 |
| MP548S | SEQ ID NO: 127 | SEQ ID NO: 128 | AM16230 |
| MP552S | SEQ ID NO: 129 | SEQ ID NO: 130 | JAPH0797 |
| MP562S | SEQ ID NO: 131 | SEQ ID NO: 132 | PO423 |
| MP564S | SEQ ID NO: 133 | SEQ ID NO: 134 | JAPH0790 |
| MP566S | SEQ ID NO: 135 | SEQ ID NO: 136 | JAPH0842 |
| MP567S | SEQ ID NO: 137 | SEQ ID NO: 138 | PO450 |
| MP569S | SEQ ID NO: 139 | SEQ ID NO: 140 | PO219 |
| MP573S | SEQ ID NO: 141 | SEQ ID NO: 142 | AM15623 |
| MP574S | SEQ ID NO: 143 | SEQ ID NO: 144 | AM16083 |
| MP575S | SEQ ID NO: 145 | SEQ ID NO: 146 | AM15623 |
| MP581S | SEQ ID NO: 147 | SEQ ID NO: 148 | PO230 |
| MP599S | SEQ ID NO: 149 | SEQ ID NO: 150 | DP1021 |
| MP600S | SEQ ID NO: 151 | SEQ ID NO: 152 | DP1019 |
| MP601S | SEQ ID NO: 153 | SEQ ID NO: 154 | DP1289 |
| MP602S | SEQ ID NO: 155 | SEQ ID NO: 156 | DP333 |
| MP604S | SEQ ID NO: 157 | SEQ ID NO: 158 | DP1289 |
| MP626S | SEQ ID NO: 159 | SEQ ID NO: 160 | DP1246 |
| MP629S | SEQ ID NO: 161 | SEQ ID NO: 162 | DP1319 |
| MP630S | SEQ ID NO: 163 | SEQ ID NO: 164 | DP1246 |
| MP631S | SEQ ID NO: 165 | SEQ ID NO: 166 | DP1289 |
| MP632S | SEQ ID NO: 167 | SEQ ID NO: 168 | DP1289 |
| MP633S | SEQ ID NO: 169 | SEQ ID NO: 170 | DP1168 |
| MP634S | SEQ ID NO: 171 | SEQ ID NO: 172 | DP1168 |
| MP635S | SEQ ID NO: 173 | SEQ ID NO: 174 | DP1168 |
| MP639S | SEQ ID NO: 175 | SEQ ID NO: 176 | DP333 |
| MP640S | SEQ ID NO: 177 | SEQ ID NO: 178 | DP879 |
| MP644S | SEQ ID NO: 179 | SEQ ID NO: 180 | DP1019 |
| MP649S | SEQ ID NO: 181 | SEQ ID NO: 182 | DP1144 |
| MP651S | SEQ ID NO: 183 | SEQ ID NO: 184 | DP2398 |
| MP652S | SEQ ID NO: 185 | SEQ ID NO: 186 | DP2009 |
| MP653S | SEQ ID NO: 187 | SEQ ID NO: 188 | DP2059 |
| MP661S | SEQ ID NO: 189 | SEQ ID NO: 190 | DP1083B |
| MP666S | SEQ ID NO: 191 | SEQ ID NO: 192 | DP2083 |
| MP672S | SEQ ID NO: 193 | SEQ ID NO: 194 | DP2009 |
| MP696S | SEQ ID NO: 195 | SEQ ID NO: 196 | DP1798 |
| MP704S | SEQ ID NO: 197 | SEQ ID NO: 198 | DP1954 |
| MP724S | SEQ ID NO: 199 | SEQ ID NO: 200 | DP1940M |
| MP729S | SEQ ID NO: 201 | SEQ ID NO: 202 | PO573 |
| MP739S | SEQ ID NO: 203 | SEQ ID NO: 204 | DP2160M |
| MP755S | SEQ ID NO: 205 | SEQ ID NO: 206 | DP529M |
| MP773S | SEQ ID NO: 207 | SEQ ID NO: 208 | DP744 |
| MP799S | SEQ ID NO: 209 | SEQ ID NO: 210 | JAPH01606 |
| MP800S | SEQ ID NO: 211 | SEQ ID NO: 212 | JAPH01969 |
| MP801S | SEQ ID NO: 213 | SEQ ID NO: 214 | AM16543 |
| MP802S | SEQ ID NO: 215 | SEQ ID NO: 216 | AM16543 |
| MP805S | SEQ ID NO: 217 | SEQ ID NO: 218 | AM16543 |
| MP809S | SEQ ID NO: 219 | SEQ ID NO: 220 | JAPH01306 |
| MP815S | SEQ ID NO: 221 | SEQ ID NO: 222 | DP2581M |
| MP828S | SEQ ID NO: 223 | SEQ ID NO: 224 | DP3557M |

TABLE 1-continued

| Identifier | polynucleotide | polypeptide | Strain ID |
|---|---|---|---|
| MP831S | SEQ ID NO: 225 | SEQ ID NO: 226 | DP3073M |
| MP844S | SEQ ID NO: 227 | SEQ ID NO: 228 | DP3073M |
| MP852 | SEQ ID NO: 229 | SEQ ID NO: 230 | DP3632M |
| MP865S | SEQ ID NO: 231 | SEQ ID NO: 232 | DP638 |
| MP879S | SEQ ID NO: 233 | SEQ ID NO: 234 | JAPH01218 |
| MP887S | SEQ ID NO: 235 | SEQ ID NO: 236 | DP372 |
| MP891S | SEQ ID NO: 237 | SEQ ID NO: 238 | DP2290M |
| MP896S | SEQ ID NO: 239 | SEQ ID NO: 240 | DP2327M |
| MP898S | SEQ ID NO: 241 | SEQ ID NO: 242 | DP563M |
| MP935S | SEQ ID NO: 243 | SEQ ID NO: 244 | BD2894 |
| MP968 | SEQ ID NO: 245 | SEQ ID NO: 246 | JAPH2628M |
| MP989 | SEQ ID NO: 247 | SEQ ID NO: 248 | JAPH2732M |
| MP993 | SEQ ID NO: 249 | SEQ ID NO: 250 | JAPH2732M |
| MP997 | SEQ ID NO: 251 | SEQ ID NO: 252 | JAPH2754M |
| MP1049 | SEQ ID NO: 253 | SEQ ID NO: 254 | DP3227M |
| MP1066 | SEQ ID NO: 255 | SEQ ID NO: 256 | JAPH2416M |
| MP1067 | SEQ ID NO: 257 | SEQ ID NO: 258 | DP3104M |
| MP1080 | SEQ ID NO: 259 | SEQ ID NO: 260 | RGB0275B |
| MP1081 | SEQ ID NO: 261 | SEQ ID NO: 262 | BD2855 |
| MP1200 | SEQ ID NO: 263 | SEQ ID NO: 264 | BD2357 |
| MP1206 | SEQ ID NO: 265 | SEQ ID NO: 266 | BD3063 |
| MP1233 | SEQ ID NO: 267 | SEQ ID NO: 268 | BD2614 |
| MP1311 | SEQ ID NO: 269 | SEQ ID NO: 270 | 104429.0 |

The polynucleotides encoding the insecticidal polypeptides of Table 1 were cloned into a pET28a vector (Novagen®) and transformed into *E. coli* BL21 cells (Invitrogen). Large scale 1.0 L cultures were grown until O.D.600 nm-0.8 and then the cultures were induced with isopropyl β-D-1-thiogalactopyranoside (IPTG) 1 mM and allowed to grow for 16 hours at 16° C. The cell pellets were lysed with 50 mL of 500 mM NaCl/20 mM Tris/5 mM Imidazole/pH 7.9 with 0.02% lysozyme (w/v) and 0.1% Tween-20 and 1 tablet of Complete Protease Inhibitor (Roche) added. After lysis, the solutions were sonicated and the lysate centrifuged at 25,000 rpm for 30 minutes. The supernatant containing the soluble protein fraction were filtered through a 0.45u vacuum filter and then 1 ml of Talon (Clontech) slurry is added and then incubated for binding on rotator at 100 rpm for 1 hour. The lysate is then added to a column and the bound protein is isolated and washed with 20 ml of 50 mmM NaCl/20 mM Tris/5 mM Imidazole/pH 7.9 and then eluted with 1.5 ml of 50 mmM NaCl/20 mM Tris/500 mM Imidazole/pH 7.9. The purified protein is then dialyzed into 50 mM sodium carbonate buffer pH10. The purified protein was submitted for insecticidal activity in panel of *Lepidoptera* and *Coleoptera* in vitro feeding assays.

Example 2—Insect Assays with Partially Purified Proteins

Insecticidal activity bioassay screens were conducted to evaluate the effects of the insecticidal proteins on a variety of *Lepidoptera* species: European corn borer (*Ostrinia nubilalis*), corn earworm (*Helicoverpa zea*), black cutworm (*Agrotis ipsilon*), fall armyworm (*Spodoptera frugiperda*), Soybean looper (*Pseudoplusia includens*) and Velvet bean caterpillar (*Anticarsia gemmatalis*) and the *Coleoptera* species western corn rootworm (*Diabrotica virgifera virgifera*).

*Lepidoptera* feeding assays were conducted on an artificial diet containing the purified protein in a 96 well plate set up. The purified protein (25 ul) is then added to the artificial diet. Two to five neonate larvas were placed in each well to feed ad libitum for 5 days. Results were expressed as positive for larvae reactions such as stunting and or mortality. Results were expressed as negative if the larvae were similar to the negative control that is feeding diet to which the above buffer only has been applied. A primary bioassay screen was performed for each purified protein at a single concentration on European corn borer (*Ostrinia nubilalis*), corn earworm (*Helicoverpa zea*), black cutworm (*Agrotis ipsilon*), fall armyworm (*Spodoptera frugiperda*), Soybean looper (*Pseudoplusia includens*) and Velvet bean caterpillar (*Anticarsia gemmatalis*). The insect assays were scored as follows: 1=insecticidal activity; 0=no activity at the highest concentration tested.

The primary insecticidal assay results for the insecticidal polypeptides are shown in Table 2.

TABLE 2

| Identifier | polypeptide | WCRW | FAW | CEW | ECB | SBL | BCW | VBC |
|---|---|---|---|---|---|---|---|---|
| MP032 | SEQ ID NO: 2 | 0 | 0 | 0 | 0 | 0 | 0 | 1 |
| MP049 | SEQ ID NO: 4 | 0 | 0 | 0 | 0 | 0 | 0 | 1 |
| MP051 | SEQ ID NO: 6 | 0 | 0 | 0 | 0 | 1 | 0 | 1 |
| MP066 | SEQ ID NO: 8 | 0 | 0 | 0 | 0 | 0 | 0 | 1 |
| MP068 | SEQ ID NO: 10 | 0 | 0 | 0 | 0 | 0 | 0 | 1 |
| MP070 | SEQ ID NO: 12 | 0 | 0 | 0 | 0 | 0 | 0 | 1 |
| MP091S | SEQ ID NO: 14 | 1 | 0 | 0 | 0 | 0 | 0 | 0 |
| MP109S | SEQ ID NO: 16 | 0 | 0 | 0 | 0 | 0 | 0 | 1 |
| MP114 | SEQ ID NO: 18 | 0 | 0 | 0 | 0 | 1 | 0 | 1 |
| MP121 | SEQ ID NO: 20 | 0 | 0 | 0 | 0 | 1 | 0 | 1 |
| MP134S | SEQ ID NO: 22 | 0 | 0 | 0 | 0 | 1 | 0 | 1 |
| MP183S | SEQ ID NO: 24 | 0 | 0 | 0 | 0 | 0 | 0 | 1 |
| MP185S | SEQ ID NO: 26 | 0 | 0 | 0 | 0 | 1 | 0 | 1 |
| MP186S | SEQ ID NO: 28 | 0 | 0 | 0 | 0 | 1 | 0 | 1 |
| MP195S | SEQ ID NO: 30 | 0 | 0 | 0 | 0 | 0 | 0 | 1 |
| MP197S | SEQ ID NO: 32 | 1 | 0 | 0 | 0 | 0 | 0 | 0 |
| MP208S | SEQ ID NO: 34 | 0 | 0 | 0 | 0 | 1 | 0 | 1 |
| MP209S | SEQ ID NO: 36 | 0 | 0 | 0 | 0 | 1 | 0 | 1 |
| MP212S | SEQ ID NO: 38 | 0 | 0 | 0 | 0 | 0 | 0 | 1 |
| MP214S | SEQ ID NO: 40 | 1 | 0 | 0 | 0 | 0 | 0 | 0 |
| MP217S | SEQ ID NO: 42 | 1 | 0 | 0 | 0 | 0 | 0 | 0 |
| MP222S | SEQ ID NO: 44 | 0 | 0 | 0 | 1 | 1 | 0 | 1 |
| MP234S | SEQ ID NO: 46 | 0 | 0 | 0 | 0 | 1 | 0 | 1 |
| MP235S | SEQ ID NO: 48 | 0 | 0 | 0 | 0 | 1 | 0 | 0 |
| MP237S | SEQ ID NO: 50 | 0 | 0 | 1 | 1 | 1 | 0 | 0 |
| MP242S | SEQ ID NO: 52 | 0 | 1 | 0 | 1 | 1 | 0 | 0 |
| MP243 | SEQ ID NO: 54 | 0 | 0 | 0 | 1 | 1 | 0 | 1 |
| MP248 | SEQ ID NO: 56 | 0 | 0 | 0 | 0 | 1 | 0 | 0 |
| MP249S | SEQ ID NO: 58 | 0 | 0 | 0 | 0 | 0 | 0 | 1 |

TABLE 2-continued

| Identifier | polypeptide | WCRW | FAW | CEW | ECB | SBL | BCW | VBC |
|---|---|---|---|---|---|---|---|---|
| MP251M | SEQ ID NO: 60 | 0 | 1 | 1 | 0 | 1 | 0 | 1 |
| MP252S | SEQ ID NO: 62 | 0 | 0 | 0 | 1 | 0 | 0 | 1 |
| MP253 | SEQ ID NO: 64 | 0 | 1 | 1 | 1 | 1 | 0 | 1 |
| MP259S | SEQ ID NO: 66 | 0 | 0 | 1 | 1 | 1 | 0 | 0 |
| MP287S | SEQ ID NO: 68 | 0 | 0 | 0 | 1 | 0 | 0 | 0 |
| MP288S | SEQ ID NO: 70 | 0 | 0 | 1 | 1 | 1 | 0 | 0 |
| MP295S | SEQ ID NO: 72 | 0 | 0 | 1 | 1 | 1 | 0 | 0 |
| MP296S | SEQ ID NO: 74 | 1 | 0 | 0 | 0 | 0 | 0 | 0 |
| MP297S | SEQ ID NO: 76 | 0 | 1 | 1 | 1 | 1 | 0 | 1 |
| MP300S | SEQ ID NO: 78 | 0 | 1 | 1 | 1 | 1 | 0 | 1 |
| MP304S | SEQ ID NO: 80 | 0 | 0 | 0 | 0 | 1 | 0 | 1 |
| MP306S | SEQ ID NO: 82 | 0 | 0 | 0 | 0 | 1 | 0 | 1 |
| MP310S | SEQ ID NO: 84 | 0 | 0 | 0 | 0 | 1 | 0 | 0 |
| MP312S | SEQ ID NO: 86 | 0 | 1 | 0 | 1 | 1 | 0 | 1 |
| MP314S | SEQ ID NO: 88 | 0 | 0 | 0 | 0 | 1 | 0 | 0 |
| MP319S | SEQ ID NO: 90 | 0 | 0 | 0 | 1 | 0 | 0 | 1 |
| MP325S | SEQ ID NO: 92 | 0 | 0 | 0 | 1 | 1 | 0 | 0 |
| MP326S | SEQ ID NO: 94 | 0 | 0 | 0 | 0 | 1 | 0 | 0 |
| MP327S | SEQ ID NO: 96 | 0 | 0 | 0 | 1 | 1 | 0 | 1 |
| MP334S | SEQ ID NO: 98 | 0 | 0 | 0 | 0 | 1 | 0 | 1 |
| MP337S | SEQ ID NO: 100 | 0 | 0 | 0 | 0 | 0 | 0 | 1 |
| MP342S | SEQ ID NO: 102 | 0 | 0 | 0 | 1 | 0 | 0 | 0 |
| MP356S | SEQ ID NO: 104 | 0 | 1 | 0 | 1 | 1 | 0 | 1 |
| MP359S | SEQ ID NO: 106 | 0 | 0 | 0 | 1 | 0 | 0 | 0 |
| MP360S | SEQ ID NO: 108 | 0 | 0 | 0 | 0 | 0 | 0 | 1 |
| MP437S | SEQ ID NO: 110 | 0 | 0 | 0 | 0 | 1 | 0 | 1 |
| MP451S | SEQ ID NO: 112 | 0 | 0 | 0 | 1 | 1 | 0 | 1 |
| MP452S | SEQ ID NO: 114 | 0 | 0 | 0 | 1 | 1 | 0 | 1 |
| MP466S | SEQ ID NO: 116 | 1 | 0 | 0 | 0 | 0 | 0 | 0 |
| MP468S | SEQ ID NO: 118 | 1 | 0 | 0 | 0 | 0 | 0 | 0 |
| MP476S | SEQ ID NO: 120 | 0 | 0 | 0 | 1 | 1 | 0 | 1 |
| MP482S | SEQ ID NO: 122 | 0 | 1 | 1 | 1 | 1 | 1 | 1 |
| MP522S | SEQ ID NO: 124 | 0 | 0 | 0 | 1 | 0 | 0 | 0 |
| MP529S | SEQ ID NO: 126 | 0 | 0 | 0 | 1 | 1 | 0 | 0 |
| MP548S | SEQ ID NO: 128 | 0 | 0 | 0 | 1 | 1 | 0 | 0 |
| MP552S | SEQ ID NO: 130 | 0 | 0 | 0 | 0 | 1 | 0 | 0 |
| MP562S | SEQ ID NO: 132 | 0 | 0 | 0 | 1 | 1 | 0 | 0 |
| MP564S | SEQ ID NO: 134 | 0 | 1 | 1 | 1 | 1 | 0 | 1 |
| MP566S | SEQ ID NO: 136 | 0 | 0 | 0 | 0 | 1 | 0 | 0 |
| MP567S | SEQ ID NO: 138 | 0 | 0 | 0 | 0 | 1 | 0 | 0 |
| MP569S | SEQ ID NO: 140 | 0 | 0 | 0 | 0 | 1 | 0 | 1 |
| MP573S | SEQ ID NO: 142 | 0 | 0 | 1 | 0 | 1 | 0 | 0 |
| MP574S | SEQ ID NO: 144 | 0 | 0 | 1 | 0 | 1 | 0 | 0 |
| MP575S | SEQ ID NO: 146 | 0 | 0 | 0 | 0 | 1 | 0 | 0 |
| MP581S | SEQ ID NO: 148 | 0 | 0 | 0 | 0 | 1 | 0 | 0 |
| MP599S | SEQ ID NO: 150 | 0 | 1 | 0 | 0 | 0 | 1 | 0 |
| MP600S | SEQ ID NO: 152 | 0 | 1 | 1 | 1 | 1 | 1 | 1 |
| MP601S | SEQ ID NO: 154 | 0 | 0 | 0 | 1 | 1 | 0 | 1 |
| MP602S | SEQ ID NO: 156 | 0 | 0 | 0 | 1 | 1 | 0 | 1 |
| MP604S | SEQ ID NO: 158 | 0 | 0 | 1 | 0 | 1 | 0 | 0 |
| MP626S | SEQ ID NO: 160 | 0 | 0 | 0 | 1 | 1 | 0 | 1 |
| MP629S | SEQ ID NO: 162 | 0 | 1 | 1 | 1 | 1 | 1 | 0 |
| MP630S | SEQ ID NO: 164 | 0 | 0 | 1 | 0 | 1 | 0 | 1 |
| MP631S | SEQ ID NO: 166 | 0 | 0 | 1 | 1 | 1 | 1 | 1 |
| MP632S | SEQ ID NO: 168 | 0 | 0 | 1 | 1 | 1 | 1 | 1 |
| MP633S | SEQ ID NO: 170 | 0 | 0 | 0 | 0 | 1 | 0 | 1 |
| MP634S | SEQ ID NO: 172 | 0 | 0 | 0 | 0 | 1 | 0 | 1 |
| MP635S | SEQ ID NO: 174 | 0 | 0 | 0 | 1 | 1 | 0 | 1 |
| MP639S | SEQ ID NO: 176 | 0 | 0 | 0 | 0 | 1 | 0 | 1 |
| MP640S | SEQ ID NO: 178 | 0 | 0 | 0 | 1 | 0 | 0 | 0 |
| MP644S | SEQ ID NO: 180 | 0 | 0 | 0 | 1 | 0 | 0 | 0 |
| MP649S | SEQ ID NO: 182 | 0 | 0 | 0 | 1 | 1 | 0 | 1 |
| MP651S | SEQ ID NO: 184 | 0 | 0 | 0 | 1 | 1 | 0 | 1 |
| MP652S | SEQ ID NO: 186 | 0 | 0 | 0 | 1 | 1 | 0 | 0 |
| MP653S | SEQ ID NO: 188 | 0 | 0 | 0 | 1 | 1 | 0 | 0 |
| MP661S | SEQ ID NO: 190 | 0 | 0 | 0 | 1 | 1 | 0 | 1 |
| MP666S | SEQ ID NO: 192 | 0 | 0 | 0 | 1 | 1 | 0 | 1 |
| MP672S | SEQ ID NO: 194 | 0 | 0 | 0 | 0 | 0 | 0 | 1 |
| MP696S | SEQ ID NO: 196 | 0 | 0 | 0 | 1 | 1 | 0 | 1 |
| MP704S | SEQ ID NO: 198 | 0 | 0 | 0 | 1 | 1 | 0 | 1 |
| MP724S | SEQ ID NO: 200 | 0 | 0 | 0 | 1 | 1 | 1 | 1 |
| MP729S | SEQ ID NO: 202 | 0 | 0 | 0 | 0 | 0 | 0 | 1 |
| MP739S | SEQ ID NO: 204 | 0 | 0 | 0 | 0 | 0 | 0 | 1 |
| MP755S | SEQ ID NO: 206 | 0 | 0 | 0 | 0 | 0 | 0 | 1 |
| MP773S | SEQ ID NO: 208 | 0 | 0 | 0 | 0 | 1 | 0 | 1 |
| MP799S | SEQ ID NO: 210 | 0 | 0 | 0 | 1 | 0 | 0 | 0 |
| MP800S | SEQ ID NO: 212 | 0 | 0 | 0 | 0 | 1 | 0 | 0 |
| MP801S | SEQ ID NO: 214 | 0 | 0 | 0 | 1 | 0 | 0 | 0 |

TABLE 2-continued

| Identifier | polypeptide | WCRW | FAW | CEW | ECB | SBL | BCW | VBC |
|---|---|---|---|---|---|---|---|---|
| MP802S | SEQ ID NO: 216 | 0 | 0 | 1 | 1 | 1 | 1 | 1 |
| MP805S | SEQ ID NO: 218 | 0 | 0 | 0 | 0 | 1 | 0 | 0 |
| MP809S | SEQ ID NO: 220 | 0 | 0 | 0 | 1 | 0 | 0 | 0 |
| MP815S | SEQ ID NO: 222 | 0 | 0 | 1 | 1 | 1 | 0 | 1 |
| MP828S | SEQ ID NO: 224 | 0 | 0 | 0 | 1 | 1 | 0 | 0 |
| MP831S | SEQ ID NO: 226 | 0 | 0 | 0 | 1 | 1 | 0 | 1 |
| MP844S | SEQ ID NO: 228 | 0 | 0 | 0 | 1 | 1 | 0 | 1 |
| MP852 | SEQ ID NO: 230 | 0 | 0 | 0 | 1 | 1 | 0 | 0 |
| MP865S | SEQ ID NO: 232 | 0 | 0 | 0 | 0 | 0 | 0 | 1 |
| MP879S | SEQ ID NO: 234 | 1 | 0 | 0 | 0 | 0 | 0 | 0 |
| MP887S | SEQ ID NO: 236 | 0 | 1 | 0 | 1 | 0 | 0 | 0 |
| MP891S | SEQ ID NO: 238 | 0 | 0 | 1 | 1 | 1 | 0 | 1 |
| MP896S | SEQ ID NO: 240 | 0 | 0 | 0 | 0 | 1 | 0 | 0 |
| MP898S | SEQ ID NO: 242 | 0 | 0 | 0 | 1 | 1 | 0 | 0 |
| MP935S | SEQ ID NO: 244 | 0 | 0 | 0 | 0 | 1 | 0 | 1 |
| MP968 | SEQ ID NO: 246 | 0 | 0 | 0 | 1 | 0 | 0 | 0 |
| MP989 | SEQ ID NO: 248 | 0 | 0 | 0 | 0 | 1 | 0 | 1 |
| MP993 | SEQ ID NO: 250 | 1 | 0 | 0 | 0 | 0 | 0 | 1 |
| MP997 | SEQ ID NO: 252 | 0 | 0 | 0 | 0 | 1 | 0 | 1 |
| MP1049 | SEQ ID NO: 254 | 1 | 0 | 0 | 1 | 0 | 0 | 0 |
| MP1066 | SEQ ID NO: 256 | 0 | 0 | 0 | 0 | 0 | 0 | 1 |
| MP1067 | SEQ ID NO: 258 | 0 | 0 | 0 | 0 | 0 | 0 | 1 |
| MP1080 | SEQ ID NO: 260 | 0 | 0 | 0 | 0 | 0 | 0 | 1 |
| MP1081 | SEQ ID NO: 262 | 0 | 0 | 0 | 0 | 0 | 0 | 1 |
| MP1200 | SEQ ID NO: 264 | 0 | 0 | 0 | 0 | 0 | 0 | 1 |
| MP1206 | SEQ ID NO: 266 | 1 | 0 | 0 | 0 | 0 | 0 | 0 |
| MP1233 | SEQ ID NO: 268 | 0 | 1 | 1 | 1 | 1 | 1 | 1 |
| MP1311 | SEQ ID NO: 270 | 1 | 1 | 1 | 1 | 1 | 1 | 1 |

Example 3—Transient Expression in Soybean Leaves and Insect Bioassay

For soybean expression optimized coding sequences are designed. To confirm activity of the insecticidal polypeptides of the disclosure a transient expression system under control of the AtUBQ10 promoter (Day, et. al., (1999) *Plant Mol. Biol.* 40:771-782; Norris S R et al (1993) *Plant Mol Biol.* 21(5):895-906) can be utilized. The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, excised leaf disks of soybean (*Glycine max*), are agro-infiltrated with normalized bacterial cell cultures of test and control strains. After 4 days leaf disks are infested with 2 neonates of Soybean Looper (SBL) (*Chrysodeixis includens*), Corn Earworm, (CEW) (*Helicoverpa zea*), Velvetbean Caterpillar (VBC) (*Anticarsia gemmatalis*), or Fall Armyworm (*Spodoptera frugiperda*) alone. Control leaf discs are generated with *Agrobacterium* containing only a DsRed2 fluorescence marker (Clontech™, 1290 Terra Bella Ave. Mountain View, Calif. 94043) expression vector. Leaf discs from non-infiltrated plants are included as a second control. The consumption of green leaf tissue is scored three days after infestation and given scores of 0 to 9.

Example 4 Transient Expression and Insect Bioassay on Transient Maize Leaf Tissues Polynucleotides of the disclosure are cloned into a transient expression vector under control of the maize ubiquitin promoter (Christensen and Quail, (1996) *Transgenic Research* 5:213-218) and a duplicated version of the promoter from the mirabilis mosaic virus (DMMV PRO; Dey and Maiti, (1999) *Plant Mol. Biol.*, 40:771-82). The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, young plantlets of maize are agro-infiltrated with normalized bacterial cell cultures of test and control strains. Leaf discs are generated from each plantlet and infested WCRW (*Diabrotica virgifera*) along with appropriate controls. The degree of consumption of green leaf tissues is scored after 2 days of infestation.

Example 5—*Agrobacterium*-Mediated Transformation of Maize and Regeneration of Transgenic Plants For *Agrobacterium*-mediated transformation of maize with a polynucleotide of the disclosure the method of Zhao can be used (U.S. Pat. No. 5,981,840 and PCT patent publication WO98/32326; the contents of which are hereby incorporated by reference). Briefly, immature embryos are isolated from maize and the embryos contacted with a suspension of *Agrobacterium* under conditions whereby the bacteria are capable of transferring the polynucleotide to at least one cell of at least one of the immature embryos (step 1: the infection step). In this step the immature embryos can be immersed in an *Agrobacterium* suspension for the initiation of inoculation. The embryos are co-cultured for a time with the *Agrobacterium* (step 2: the co-cultivation step). The immature embryos can be cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos can be cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium can be cultured on solid medium to regenerate the plants.

Example 6—Transformation of Soybean Embryos

Soybean embryos are bombarded with a plasmid containing a polynucleotide of the disclosure operably linked to a suitable promoter as follows. To induce somatic embryos, cotyledons, 3-5 mm in length dissected from surface-sterilized, immature seeds of an appropriate soybean cultivar are cultured in the light or dark at 26° C. on an appropriate agar medium for six to ten weeks. Somatic embryos producing secondary embryos are then excised and placed into a suitable liquid medium. After repeated selection for clusters of somatic embryos that multiplied as early, globular-staged embryos, the suspensions are maintained as described below.

Soybean embryogenic suspension cultures are maintained in 35 mL liquid media on a rotary shaker, 150 rpm, at 26° C. with florescent lights on a 16:8 hour day/night schedule. Cultures are subcultured every two weeks by inoculating approximately 35 mg of tissue into 35 mL of liquid medium.

Soybean embryogenic suspension cultures are then transformed by the method of particle gun bombardment (Klein, et al., (1987) Nature (London) 327:70-73, U.S. Pat. No. 4,945,050). A Du Pont Biolistic PDS1000/HE instrument (helium retrofit) can be used for these transformations.

A selectable marker gene that can be used to facilitate soybean transformation includes, but is not limited to: the 35S promoter from Cauliflower Mosaic Virus (Odell, et al., (1985) Nature 313:810-812), the hygromycin phosphotransferase gene from plasmid pJR225 (from *E. coli*; Gritz, et al., (1983) Gene 25:179-188), and the 3' region of the nopaline synthase gene from the T DNA of the Ti plasmid of *Agrobacterium tumefaciens*. The expression cassette comprising a polynucleotide of the disclosure operably linked to a suitable promoter can be isolated as a restriction fragment. This fragment can then be inserted into a unique restriction site of the vector carrying the marker gene.

To 50 µL of a 60 mg/mL 1 µm gold particle suspension is added (in order): 5 µL DNA (1 µg/µL), 20 µL spermidine (0.1 M), and 50 µL CaCl2) (2.5M). The particle preparation is then agitated for three minutes, spun in a microfuge for 10 seconds and the supernatant removed. The DNA-coated particles are then washed once in 400 µL 70% ethanol and resuspended in 40 µL of anhydrous ethanol. The DNA/particle suspension is sonicated three times for one second each. Five microliters of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately 5-10 plates of tissue are normally bombarded. Membrane rupture pressure is set at 1100 psi, and the chamber is evacuated to a vacuum of 28 inches mercury. The tissue is placed approximately 3.5 inches away from the retaining screen and bombarded three times. Following bombardment, the tissue is divided in half and placed back into liquid and cultured as described above.

Five to seven days post bombardment the liquid media is exchanged with fresh media, and eleven to twelve days post-bombardment with fresh media containing 50 mg/mL hygromycin. This selective media is refreshed weekly. Seven to eight weeks post-bombardment, green, transformed tissue is observed growing from untransformed, necrotic embryogenic clusters. Isolated green tissue is removed and inoculated into individual flasks to generate new, clonally propagated, transformed embryogenic suspension cultures. Each new line is treated as an independent transformation event. These suspensions are then subcultured and maintained as clusters of immature embryos or regenerated into whole plants by maturation and germination of individual somatic embryos.

Example 7—Regeneration of Soybean Somatic Embryos into Plants

In order to obtain whole plants from embryogenic suspension cultures, the tissue must be regenerated.

Embryo Maturation

Embryos are cultured for 4-6 weeks at 26° C. in SB196 under cool white fluorescent (Phillips cool white Econowatt F40/CW/RS/EW) and Agro (Phillips F40 Agro) bulbs (40 watt) on a 16:8 hr photoperiod with light intensity of 90-120 µE/m$^2$s. After this time embryo clusters are removed to a solid agar media, SB166, for 1-2 weeks. Clusters are then subcultured to medium SB103 for 3 weeks. During this period, individual embryos are removed from the clusters and screened for ABA accumulation. It should be noted that any detectable phenotype, resulting from the expression of the genes of interest, could be screened at this stage.

Embryo Desiccation and Germination

Matured individual embryos are desiccated by placing them into an empty, small petri dish (35×10 mm) for approximately 4-7 days. The plates are sealed with fiber tape (creating a small humidity chamber). Desiccated embryos are planted into SB71-4 medium where they are left to germinate under the same culture conditions described above. Germinated plantlets are removed from germination medium and rinsed thoroughly with water and then planted in Redi-Earth™ in 24-cell pack tray, covered with clear plastic dome. After 2 weeks the dome is removed and plants hardened off for a further week. If plantlets looked hardy they are transplanted to 10" pot of Redi-Earth™ with up to 3 plantlets per pot.

Analysis of Leaf Tissues from Transgenic Soybean Events

Leaf tissue is harvested at approximately V3/V4 and fed to Lepidopteran species of interest. leaf disks are infested with 2 neonates of Soybean Looper (SBL) (*Chrysodeixis includens*), Corn Earworm, (CEW) (*Helicoverpa zea*), Velvetbean Caterpillar (VBC) (*Anticarsia gemmatalis*), or Fall Armyworm (*Spodoptera frugiperda*) alone. Leaf discs from wild type plants are included as a control. The consumption of green leaf tissue is scored five days after infestation and given scores of 0 to 9. Protein expression of can be confirmed by western blot using antibodies raised to the polypeptide.

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (270 sequences)

SEQ ID NO: 1 - DNA, 2370 bp, Bacillus thuringiensis
atgtccgagggctatgatagagaatattttgcaaatcctgaagtgtttgctgtaccatcgggagttacaacggggattaatatagttactaaattactgggatggttaggggttccattggttggagaagcagcgacagctcttaatctcattctaggtcaattatggccggcatcaggaaacccgtgggctgaattaatgataatggtagaagaactcataaatcaaaaaatagaagaggctgtaagaaacaaagcacttgcagatttggccaattcaggtagagcgctccaatcctatttaaacgcatttgaagattggcaaaaaaaccctaataattttcggagtaaagagctagtaagagaaagattttcaaacgcggaacattcattgcgcaccgaaatgagttcttttgccataagaggatttgaaataccacttttggcaacatatgcgcaagctgctaatttacatttatttctaattaaagatgttcaaatttatgggaaagaatggggatattctcaaggtgatattgatttattttatagagaacaagtagagtttacgaaagaatacaccgaacactgtatcaatatttataatgatggtctaaataaattaaaaggttcgagtgctaagcaatggattacatttaatcgcttccgtagagaaatgactttgacggtactagatgtggtttcattattcccgaactatgatgtacgtatgtaccctttaaaaacaaatacagagctaacgagaacaatttatactgatccgcttggttacacgaaaacggattctagtaatacaccaccatggtataattatgggtctagtttctcatatatagaaagtatagcgattccatcccctacagcggttaagtggttacagtcagttagaatttattcaaaattcacaagggctacaccacaaagtgcggattattgggcaggacatactataacatatcgatttactggcgatagttataatgtattggctaattatggagatatatcgaatcctgtagctgtagataattattattttgacacgactgaaatttatagagtttcatcatctgttgcttcaagcacaaatgctggtgttaagttattaactactaaggctatatttaatgggataaatacacaaaatggattagagagttatgagtatgtaaaatcatcgaacttttttaatgaactaaaagacacaattacagagctacctgttcagttatccaatcctcctacctacggggatcctgaacagtacagccataggctatcctatatttctaatgctccaacagagtacagttggggaggatatagaattgagggactaatcccagtacttggttggacacatactagtttaactcgacaacaccagataaattctgaaacaattactcaaattccaatggtaaaacaaaatttcggattacctatcatagctggacctggatttacagggggagatatactaaatttaactattcaggcaattaaagagaaatcattgacgctaagagttaagtacgatggttctccatcgcaaaaattccgtattagaatcaagtatgcatctatcagagcaggaaactttaaaatatcttctaaatctgttgagaacccttcaatagatgagacttcatttgcatttaaaaaatcgatggatagcactactgatttaacatacgaaaattttgtatatgcagaatcctcacctatagcattgggaaatccaggtatctcgcgtaatttcgatataacgctaacaaaacaagcggcttctggcgccaatgtttctactatggatactatatatattgatagaattgaattcatcccagtaaaggcaacatacgaggcggagacagatttagaaacagcgaagaaagcagtgaatgccttgtttacaaatacaaaagatggcttacgaacaggcgtaacggattatgaagtgaatcaagcggcaaacttagtggaatgcctatcggatgatttgtatccaaatgaaaaacgcttgttatttgatgcagtcagagaggcaaaacgactcagcgaggcacgtaatttactacaagatccagatttccaagagataaatggagaaaatggatggacggcaagtacgggagtcgagattatagaaggagatgctgtatttaaaggacgttatctacgcctaccaggtgcacgagaaatggatacggaaacgtatcctacgtatctatatcaaaaagtagaggaaggtgtattaaaaccatacacaagatatagattgagagggtttgtcggaagtagtcaaggcttggaaattttcacaattcgtcatcagacgaatcgaatt

SEQ ID NO: 2 - protein, 790 aa, Bacillus thuringiensis
MSEGYDREYFANPEVFAVPSGVTTGINIVTKLLGWLGVPLVGEAATALNLILGQLWPASGNPWAELMIMVEELINQKIEEAVRNKALADLANSGRALQSYLNAFEDWQKNPNNFRSKELVRERFSNAEHSLRTEMSSFAIRGFEIPLLATYAQAANLHLFLIKDVQIYGKEWGYSQGDIDLFYREQVEFTKEYTEHCINIYNDGLNKLKGSSAKQWITFNRFRREMTLTVLDVVSLFPNYDVRMYPLKTNTELTRTIYTDPLGYTKTDSSNTPPWYNYGSSFSYIESIAIPSPTAVKWLQSVRIYSKFTRATPQSADYWAGHTITYRFTGDSYNVLANYGDISNPVAVDNYYFDTTEIYRVSSSVASSTNAGVKLLTTKAIFNGINTQNGLESYEYVKSSNFFNELKDTITELPVQLSNPPTYGDPEQYSHRLSYISNAPTEYSWGGYRIEGLIPVLGWTHTSLTRQHQINSETITQIPMVKQNFGLPIIAGPGFTGGDILNLTIQAIKEKSLTLRVKYDGSPSQKFRIRIKYASIRAGNFKISSKSVENPSIDETSFAFKKSMDSTTDLTYENFVYAESSPIALGNPGISRNFDITLTKQAASGANVSTMDTIYIDRIEFIPVKATYEAETDLETAKKAVNALFTNTKDGLRTGVTDYEVNQAANLVECLSDDLYPNEKRLLFDAVREAKRLSEARNLLQDPDFQEINGENGWTASTGVEIIEGDAVFKGRYLRLPGAREMDTETYPTYLYQKVEEGVLKPYTRYRLRGFVGSSQGLEIFTIRHQTNRI

SEQ ID NO: 3 - DNA, 2583 bp, Bacillus thuringiensis
atgtttttgaatgggtatgtaaatactgtgtacgcagacagtaagacaaatcagatttctacaacgcaggaaaaccaacagaaagagatggatcgaaaaggattacttgggtattatttcaaaggaaaagattttagtaatcttattatgttttcaccaacacgtgataatacccttatttatgaccaacaaacagcgaatacattactagataaaaaacaacaagaatatcagtctattcgctggattggtttgatccagagtaaagaaacgggtgatttcacatttaacttatcagatgatgaacatgcgattatagaaatagatggaaaagttatttctcataaaggtaaagaaaagcaagttgttcatttggaaaaagggaagttggttccaataaaagttgagtatcaatcagatgaaacattaaatatggatagtcaaacctttaaaaatcttaagctattcaaagtcgatagtcaaaatcaatcccatcaagtccaactagatgaattaagaaaccctgcgtttaataaaaaagaaacacaagaattcatagcgaaagcatcaaaaacaaatctttttactcaaaaaactaagagagacattgatgaagtcatggatacagatggagactctattccagatttttgggaggaaaatggatacacgattcaaaataaaattgctgtcaaatgggatgattcgctagcaagtaaagggtatacaaaatttgtttcgaatccactagatagccacacagttggcgatccctataccgattatgaaaaagcagcgagagatttagatctagcaaatgcaaaagaaacatttaacccattagtagctgcttttccaagcgtgaatgttaatatggaaaaagtaatattatccccaaatgaaaatttatctaacagcgcagagtctcactcatctacaaattggtcctatacaaatacagaaggagcatctgttgaagcagggattggaccaacaggtctttcttttggagtgagtgtaaactatcaacattctgaaacagttgcacaggaatgggggacatctacaggaaatacttcgcaattcaatacagcttcagcagggtatttgaatgcgaatgttcgatataataatgtagggactggtgccatctatgaggtgaaacctacaacaagttttgtgctggataaaaataccatcgcaacgattacggcaaaatcgaattcaacagctttaaatatatctcctggagaaagttatccgaaaaaagggcaaaatggaatcgctataacatcaatggatgattttaattcccatccaattacattaaataaacaacaagtagatcaattgttaaataataaacctatgatgttggaaacaaaccaaacagatggcgtttataaaataaaagatacaggtggtaatcttgtgaccggtggcgaatggaatggtgtgacacaacaagttgaagccaaaactgcttctattatcgtggatgatggaaaacgtgtggcagagaaacgtgtggccgcaaaagattataattatccggaagataaaacaccatcgttaaccttaaaagatgcgctgaagctttcataccctgaccagataaaagaagtcgatggattgttgtattttgatgaacaacccatctatgaagcgagtgtaatgacttacctagatgaaaatacagcaaaagaagtgaagaaacaaatcaatgatacaaccggaaaattcaaggatgtcaataagttatatgatgtaaaactgacaccaaagatgaattttacgcttaaaatggctacattgtatgatgacgcggagcagggggaaaacattgaacctttaggacactggtattacacttataatgttgttgggggaaataccgggaaaagacagtatcgatcagctcatcctagtgcatctgtagctctatcctcagaaatgaaaaagaaactaaataaaaatacgaattattatctaagcatgtatatgaaggccgattctaatacagagcctacaatagaagtaactggtgagaaatccgcaataacgagtaaaaaagtaaaattaaataatcagggttatcaaagagttgatattttaataaaaaattttgaaagaaatccaatagataaaatatatataagaggaaatgatacgacaaatgtatattgggatgatatcgctatttcagaggtatcagctataagtccagctagtctatcagatcaagaaattaaggaaatatataaagattacaccgaacaaattgttgattggtcaaatgggaagtatttagacaatgttactttcaagaatatcaaacccttacaaaattatgtaaaaaaatacagagttgaatatactagattcggacatcctgaggatacaattaatcaggttagagacagccgtgaagttaatgctaatggaagtgtgcaagttaatatgttggattataataaaggacatggaattaatgtaggtttttggggaggaggatacgctgtaactatttttgctgtaacagatgacggaagagaaataccggtttatgacataggtagcaaa

SEQ ID NO: 4 - protein, 861 aa, Bacillus thuringiensis
MFLNGYVNTVYADSKTNQISTTQENQQKEMDRKGLLGYYFKGKDFSNLIMFSPTRDNTLIYDQQTANTLLDKKQQEYQSIRWIGLIQSKETGDFTFNLSDDEHAIIEIDGKVISHKGKEKQVVHLEKGKLVPIKVEYQSDETLNMDSQTFKNLKLFKVDSQNQSHQVQLDELRNPAFNKKETQEFIAKASKTNLFTQKTKRDIDEVMDTDGDSIPDFWEENGYTIQNKIAVKWDDSLASKGYTKFVSNPLDSHTVGDPYTDYEKAARDLDLANAKETFNPLVAAFPSVNVNMEKVILSPNENLSNSAESHSSTNWSYTNTEGASVEAGIGPTGLSFGVSVNYQHSETVAQEWGTSTGNTSQFNTASAGYLNANVRYNNVGTGAIYEVKPTTSFVLDKNTIATITAKSNSTALNISPGESYPKKGQNGIAITSMDDFNSHPITLNKQQVDQLLNNKPMMLETNQTDGVYKIKDTGGNLVTGGEWNGVTQQVEAKTASIIVDDGKRVAEKRVAAKDYNYPEDKTPSLTLKDALKLSYPDQIKEVDGLLYFDEQPIYEASVMTYLDENTAKEVKKQINDTTGKFKDVNKLYDVKLTPKMNFTLKMATLYDDAEQGENIEPLGHWYYTYNVVGGNTGKRQYRSAHPSASVALSSEMKKKLNKNTNYYLSMYMKADSNTEPTIEVTGEKSAITSKKVKLNNQGYQRVDILIKNFERNPIDKIYIRGNDTTNVYWDDIAISEVSAISPASLSDQEIKEIYKDYTEQIVDWSNGKYLDNVTFKNIKPLQNYVKKYRVEYTRFGHPEDTINQVRDSREVNANGSVQVNMLDYNKGHGINVGFWGGGYAVTIFAVTDDGREIPVYDIGSK

SEQ ID NO: 5 - DNA, 3084 bp, Bacillus thuringiensis
atgattagaaataaaatagaagaacgtattgatatagaatcttcacaaataagaacatggataaattcaggtaaattctcagaagaaatgttctctaatcgtttgaaagaacttaatttaacccttaataattttgtaagcatttttaatgcaaaagaattttatttagataatagtgcaatgcactggattaatactttattaaatgtattaaaagaacaaaccacttctgcagaatatggggagtttagtaaagcacttccttttaatagctttgtaataccccttttagcttatggagataaactattattaaaagaagttaatattatcaattccgaattaatagaatggttttcaatacgtaaatctatactttcagcactagcgcgtgaactaagtgagctatcattaaaggttttaatcaaagaaatacatatatcaaaaaaattaggagagcttaaaggggaagataagtattctcgttataagtatttcaacgaaataatgcttaaggataatgattttgttatcgacatattactagcatatccggttttaacaaggttattaatcgaaaaaactgaaaatttagttgcttcatatattgaggcgctatcccgttatataaatgattttccttctataaagattgattttcatattgatggtttaattttgaaaaatatagaaggtaataatggagattctcataaaaatggcagaagtgttatgctatttgagtatgagaatggtgagaagttggtatataaaccacgttctatgagtgttgatgagcattttaatgatttacttgaatggataaattttaaagagacaacatttgaatttaaagggccaaaaacaaaaaattataatacatatggttggcaagaatttattaaacataaaccttgtgaaaacgtgaaagaagtggagcaattttactatcgacaaggtggatatttagcactcttatatttattacgatcaaaagattttcattatgaaaatttaattgcaaatggagcacacccgatcttaatagacttagaaactttatttgataatgtgattaatttccaaaacattgatactaaatttggcgatggtgtttcggactatacggaatcaattttaggttctgctatgttaccatttaattttgtcaaacgtaaaggtatggatttagattttagtgcattaggagttctagaagaaggtgaactagctgagttttctaaaaattatacaattgctaatgaaaatactgatgaaattcggttaaaggaaatacctgtgaaggctgaaaaaaaagaaaatctccctgttttatctaatatatcagttggttcatatgagtatattgatgttatagaagagggttttcaaacgttatacacttttttccttcgtaataaagaagaattagcttctaaacaaggtcctatttataaatttgaaaatgatgaaattcgccatgtgtttagaaatacaaatctatatgtaaatttcctagtttgtggaaagcatccggaatacttacaagatggccttaataggaataaattgtttgatattttatggggagatgttaaaaatgaaagtaaatatattaaatttgttaatagtgaatgtaatgaccttttgaatcaagatgttccatacttcacttttaaatttaatagcaaggatttaataaatagtaaagggaatattattaaagacttttatgataaaagtagtttagaattagtattagaacgttgtatgaagcttagtttaaatgattgtcgacgacaaagcagatatatacgaatgtctttatctacattaaataaggatagaggagaagcggttattaaacctaatccagaaaaaatagctggtgttaaatctcaagatttcttagaagagtctttaaacataggtgaagaaatttcaaatcatttaagaccattatcatccgaaagagaaataaatcgttttgcttcatctatggggaaaaatattgagggaaatggtattactttgggcccattagatgaggggatttatgatggattttctgggttagcagtattttttggccagttagcttcagaaacaaatgataagtctttaaaaatattgtctgaagatatttttgattacgcttataaaacagctaaatttaatcacaagagattaaaaaatccctctgcatttactggaattggttcgatactatacactgccgcttattttcatttgttatgggatggtcctaaatattatgatgtagtagtagagaatttgaatcttctagaggaactaaatcaaacaaataaagtacatgactatcttactggagaggcaggagtaattctagtatgtctacgtatatacgaaaaattctctaacgaacaagcactttcaattgctattaaattaggagaatatatagttgaagagttatctgttccaggagaaatagacaagttattaactggtttttcgcatggtgcttcagggtatgcatggcccttaatgtcattaggacatataacaaaagacgagaaatttataaaattagctaataaattaataagatatgaaaataatttattcgataagcaatatcaaaattggcttgatttgaggcctcaagtgaaaaataaaactggatcttattattggtgtcatggggcaccaggtatagcattagcacgtcataatatcttgcagttgaatatgaaccctcaagaacaaagggaacaattaactgaagatcttagaattgcagttaaagctactttaaagaatggatttaagtttaatcattgtttatgtcatggagatttaggaaatatagatattttgttaacaatagctaaagaacaaaataatatacaattattaactgaagtcttaagtataggatttggcgttttagaacaaggtaaaaaattaaagtggatgaatggtattgataaaaaatctgaaatgtatgggtttatgctaggattatcaggcataggatttgaactattaagactttggaataatgatattccttcaatactaaatttagaattaccttca

SEQ ID NO: 6 - protein, 1028 aa, Bacillus thuringiensis
MIRNKIEERIDIESSQIRTWINSGKFSEEMFSNRLKELNLTLNNFVSIFNAKEFYLDNSAMHWINTLLNVLKEQTTSAEYGEFSKALPFNSFVIPLLAYGDKLLLKEVNIINSELIEWFSIRKSILSALARELSELSLKVLIKEIHISKKLGELKGEDKYSRYKYFNEIMLKDNDFVIDILLAYPVLTRLLIEKTENLVASYIEALSRYINDFPSIKIDFHIDGLILKNIEGNNGDSHKNGRSVMLFEYENGEKLVYKPRSMSVDEHFNDLLEWINFKETTFEFKGPKTKNYNTYGWQEFIKHKPCENVKEVEQFYYRQGGYLALLYLLRSKDFHYENLIANGAHPILIDLETLFDNVINFQNIDTKFGDGVSDYTESILGSAMLPFNFVKRKGMDLDFSALGVLEEGELAEFSKNYTIANENTDEIRLKEIPVKAEKKENLPVLSNISVGSYEYIDVIEEGFQTLYTFFLRNKEELASKQGPIYKFENDEIRHVFRNTNLYVNFLVCGKHPEYLQDGLNRNKLFDILWGDVKNESKYIKFVNSECNDLLNQDVPYFTFKFNSKDLINSKGNIIKDFYDKSSLELVLERCMKLSLNDCRRQSRYIRMSLSTLNKDRGEAVIKPNPEKIAGVKSQDFLEESLNIGEEISNHLRPLSSEREINRFASSMGKNIEGNGITLGPLDEGIYDGFSGLAVFFGQLASETNDKSLKILSEDIFDYAYKTAKFNHKRLKNPSAFTGIGSILYTAAYFHLLWDGPKYYDVVVENLNLLEELNQTNKVHDYLTGEAGVILVCLRIYEKFSNEQALSIAIKLGEYIVEELSVPGEIDKLLTGFSHGASGYAWPLMSLGHITKDEKFIKLANKLIRYENNLFDKQYQNWLDLRPQVKNKTGSYYWCHGAPGIALARHNILQLNMNPQEQREQLTEDLRIAVKATLKNGFKFNHCLCHGDLGNIDILLTIAKEQNNIQLLTEVLSIGFGVLEQGKKLKWMNGIDKKSEMYGFMLGLSGIGFELLRLWNNDIPSILNLELPS

SEQ ID NO: 7 - DNA, 1668 bp, Bacillus thuringiensis
atgcaacatttagttcaatttgtatgggcatataaattagcgaaacaaggaaaggaaggatttgctagtccatatgtatatgtaagagaatttcaagatgagatccttgatttcatctctacaaacccacctaaattcggggtgaattggacatgtactatggacgttgcgattcgggcggctaattggcttttagtttatgatttatttaaagtacaaggagtcgaatttgataaggaatttgaaaaaatatttgtactttctatgcatgatcatggtaattttatttttaataatttagagcgtaataaggatataaggaataatcattatttatctaatattgtggggctattctttatagctacataccttcctgccacagaagtggtatcacagtggttaaatttttcattccaagaattaattcaagagatgagttttcaattttatgaagaaggctcaaactttgaaaattcaactacttatcatcgcttatctagcgaactcatgctttatgcaacaacagtagcgctagcattacctgaagagaaaataaaggtattgcatagttatagattgcaaaatcatattgaaatttgtaaaaaactaggatttgaaattgattcggataaattttgggatttccataatgggaaaattttcccaaattggtatatagagagattagaaaaaacggctgagtttacagctgatattactaagcctaatggagaggttgcacagtttggtgataatgatagtggaagattctttaagatacagccgtcttataatttattaacagttcaggaagctaagcaaagatacttaaatttaagtacttataatgaattaagtgataaagaaaattactgggatgaggactttttagaacatcgctttctagtagcgggaattaatgctttatttaaaaggaagaaattttttagctttgtaaataaaccttctatagaatatgtattaattaaaaatatggtgaaggatcatatggaaacatatgaagaatctattttaccgtttttaaaatataatgttttagaaatctctataaataaaaaggaaaaaaatgaaataaataaattagagcaacaagaaaattttgttcaatatgttttttattctaaatctaatttagttgagggtataaaaaagatagcatatcctgactttggtatgtatatttttaaatctcaagatttttatttagctattagatgtgggaagctaggtagtaatggaaaaggaagtcatgatcataatgatcaacttagtatcgaattagtaatagatggtaaaaatgttataaaagatcctggaacatatctatacaccccaataccagagaaaagaaatttatttagatcaacaaaagcacattttacaatccaatcaggtgatatagaacaaaataatttttatgctggattgaatggtttgtttagtttagaacataatacaaatagccagtgtttggaatttaaaaataatagttttgtagggtgccatagtggttatggtcagaaagtatatagggaaatagaaatatgtgacaaacaagtagtgataaccgattttggaacaagtattgttaatccagaattcaattactattcaaatggttacggacgaattattaggaataaa

SEQ ID NO: 8 - protein, 556 aa, Bacillus thuringiensis
MQHLVQFVWAYKLAKQGKEGFASPYVYVREFQDEILDFISTNPPKFGVNWTCTMDVAIRAANWLLVYDLFKVQGVEFDKEFEKIFVLSMHDHGNFIFNNLERNKDIRNNHYLSNIVGLFFIATYLPATEVVSQWLNFSFQELIQEMSFQFYEEGSNFENSTTYHRLSSELMLYATTVALALPEEKIKVLHSYRLQNHIEICKKLGFEIDSDKFWDFHNGKIFPNWYIERLEKTAEFTADITKPNGEVAQFGDNDSGRFFKIQPSYNLLTVQEAKQRYLNLSTYNELSDKENYWDEDFLEHRFLVAGINALFKRKKFFSFVNKPSIEYVLIKNMVKDHMETYEESILPFLKYNVLEISINKKEKNEINKLEQQENFVQYVFYSKSNLVEGIKKIAYPDFGMYIFKSQDFYLAIRCGKLGSNGKGSHDHNDQLSIELVIDGKNVIKDPGTYLYTPIPEKRNLFRSTKAHFTIQSGDIEQNNFYAGLNGLFSLEHNTNSQCLEFKNNSFVGCHSGYGQKVYREIEICDKQVVITDFGTSIVNPEFNYYSNGYGRIIRNK

SEQ ID NO: 9 - DNA, 2106 bp, Bacillus thuringiensis
atggatttcaaagatttaggtattagctatcaatatagatctggtgatgaagaacaaaatattgtaaatgatttttatgtacctacgttatctcagacaaagatatataagcgcgcagtaggctattttacgagtgcttccttagctattgtaggaaaagggttaaatgagatgattagtaataacggaaaaatgtacttgattgcttcaccatatcttgaaaaagcagatattgaagcgatcgaatctggatataaagcacgtaatgaagtgatagaggaatccttattaagagctttaaatcagccagtagatttagttgttaaagaacgactaaattatttagcatggttaatagcaaatggaaggttagagataaaaattgctactctatcaaatagcgctacctatggtttatatcatgagaaaatcggtattatggaggatggagaaggaaataaaatagctttttccggatctgctaatgaaacagagggtggtctatataataattttgaatctattgatgtattttgctcgtggaacaaaaacgagttgataagagtagagagaaaagatagagatttcgatttgttatggcagaataaaacaaataaagttcaggttatcgattttcctcaagctgctaaggaaaaattattaagctttaaagaatatacaatcaagaaggttgatccagaaatccagtctaatattgttattaaggaagataatcaacgttgctactttcccgatattcctaaagagtatacaataagaaattatcaaaaggaagctataaagagttggtttgaaaacgaatgtaaaggtctactcgagatggcaacgggcacagggaaaactattacggcattgtcagcggtatcattcttatggaaagcgttatcaaggaggttagcggtgattatagtttgtccgtatacacatttagtagatcaatgggtaaaagacattaaaaaatttaatatgaacccattggtagcgaaacaatctcgaaatttatgggaagaagatttgaggttcaatattagtgcgtttaaaaatggtattattaatcatttttgtttaataaccacaaataaaactttttcaagcaagacgatgcaagatttattatctcaattaaaaggagaagttgtatttgtagcggatgaagcccatcatctaggtgctattaataatagaatgaatcttatggagcatttcccgtatcgtttagctttatctgcaacacctaatcgttggtatgatgaggaaggaagtgaagcgttgctaaaatattttggaggaaaagtagtttttgagtttggtttaaaaaaagctataggagaatttttaacagaatattattattatcctcatgtggtttatctaggtatagatgaaaatgaaaaatactatgaaattacaaggaaactatcgaaattttatagtcctaatggagaattagacttaaaggacaatgagggattacaaaaattattgattgaaagagcgaggattttaaatagtgcaagaaataaacttattaaattaaaagaattgatagggggaaataaagaatctaaatataatattatatactgtggagatagctcaatagataacgaaaaacaggttagtgcagttgtgaaattgttgggtaatgaattaaatatgagagctcatacatttacatctaatgaaagtagtttacagagacaagagtcattaaaaagatttgaactaggagagctccaagcactggtagctataaaatgtttagatgaaggtgtagatgtaccagctacccagaatgcttatattcttgctagtagtactaatccaagagagtttattcaaaggagaggaagggtattaagaaaacaccctaataagcggtattcatatattcatgattttattgttattccaagagagattgatgagattgaatatttggagcctagtgtttttaatatagaacgaaaaatggtgaaacgtgaattaataaggtttgtagaatttgctaatttggcacgaaatggtccagtagcacatgagcaactagaagaaataaaaaagccttataatctattagatatg

SEQ ID NO: 10 - protein, 702 aa, Bacillus thuringiensis
MDFKDLGISYQYRSGDEEQNIVNDFYVPTLSQTKIYKRAVGYFTSASLAIVGKGLNEMISNNGKMYLIASPYLEKADIEAIESGYKARNEVIEESLLRALNQPVDLVVKERLNYLAWLIANGRLEIKIATLSNSATYGLYHEKIGIMEDGEGNKIAFSGSANETEGGLYNNFESIDVFCSWNKNELIRVERKDRDFDLLWQNKTNKVQVIDFPQAAKEKLLSFKEYTIKKVDPEIQSNIVIKEDNQRCYFPDIPKEYTIRNYQKEAIKSWFENECKGLLEMATGTGKTITALSAVSFLWKALSRRLAVIIVCPYTHLVDQWVKDIKKFNMNPLVAKQSRNLWEEDLRFNISAFKNGIINHFCLITTNKTFSSKTMQDLLSQLKGEVVFVADEAHHLGAINNRMNLMEHFPYRLALSATPNRWYDEEGSEALLKYFGGKVVFEFGLKKAIGEFLTEYYYYPHVVYLGIDENEKYYEITRKLSKFYSPNGELDLKDNEGLQKLLIERARILNSARNKLIKLKELIGGNKESKYNIIYCGDSSIDNEKQVSAVVKLLGNELNMRAHTFTSNESSLQRQESLKRFELGELQALVAIKCLDEGVDVPATQNAYILASSTNPREFIQRRGRVLRKHPNKRYSYIHDFIVIPREIDEIEYLEPSVFNIERKMVKRELIRFVEFANLARNGPVAHEQLEEIKKPYNLLDM

SEQ ID NO: 11 - DNA, 2016 bp, Bacillus thuringiensis
atgattttagaatctattattttaaggaacttcaggcagtactatagctcgcaaattattgaattttctcaatcaaacactcgaaatgtaacagttatccatggggaaaatggtgcaggaaagacagcacttcttaatgcatttagttggtgcctatatggagagcttaatttgcccaatgctagtaatatcataaatgaacatgctgtgaatgaaatagaagatggagaggaagttgaggcacttgtcactattcaatttaaggagaaagttaaaggttcagtggcacatgaaaagcattattcgcttactagaagtatcaaggcaagaaaaattagtgaggaacagataaattactctgaaccagaagtgagattagaatacagagaagatggtcaatcgaaattagaagttgctaacattggaatagagataaatcggattttaccggagcaactttcatcttattttttctttgatggagagagaatagataatttatcgaaagaatctggaactgaagaagtaaaagaagctattaaaacaatgatgggactagaaattttagagcgttctattttacatacggaaggcgcgagaaaaagatttttaacagagttaaaacaatatggtgacgtggaaacaagaaatttagtagaagaaattgaaaatttacataagcaaaaagaagagttggaatcagaagaaaaagaatttaaacagtatcataagtcaatagagaagcagataaaagaaaaagaagaacgattaagacaaattgaagattcaaagcgtctacaagaacagagagatgtaaagacaaaagagctaaatacttctgaagaagaacttgttagtactcggaaaagattagctgatttgatgagtaaacaaggttatttagcatttagtttcctggctatagataaagctcaagatgtactcgcgaataaaaatttaaacaataatacctatacagggattaatgcttcgtttcttgatcaattgattattcaagaagaatgtatatgtggaacccatttaataacaggttcagcagagtataataaagttatagatactaaaaattatttggctcccataagtcttgaacatgctattgcagaatttcaaagtgacgtaaaaataacaaaagatagaaaacagaagttatttgaaggtatgggacaattaaggttacaggagtctaattttaagcaaaagatacgattgctaaatgaagcaattgaggaaataggcaaaaaaatttcggataaggattctgaggagattgtaactcttgaaaatgtaagagaacaattaattacaaagaagagtcaaatagatcaaagaattggggttattcaacatcaactaaatgaaataagtgagaaactagataaaaaaaataatgagcgagaaaaacttaatcaaaaagtggaaaaagcagctgttacagaaaaaagaattaaagcttgtgaagaattaattgaggtaatgaaagaaatctacaagttacgcgaaaagatcgtaaaagagcaacttcaagagcgtgttgccaaagtatacactaagtttttaagaaaagattataaaattagattatctaatgactatgaactagatgttattaatggtaacggaaataaagtgggtatgtctcaaggagaacgccaaattacaagtttgtcttttataggggcgattgtggatattgcaagagagcaatttaatgaaaagaatataaatagatttgaagagggaggcatttatccaattgtaatggattcaccctttggagctttagattcagatcatcgtgaaagaatagcaaaaggaattcctgaactttcagaccaagtcattgttattgtttctacttctcaatggaaaggagaagtagaggagaaaatgcgtgataaaattggaaaagagtacggactaaattataatgatccacgtattaataaagagaaaaactatgaatttacagaaattaccgaggtcgtaacaaaa

SEQ ID NO: 12 - protein, 672 aa, Bacillus thuringiensis
MILESIILRNFRQYYSSQIIEFSQSNTRNVTVIHGENGAGKTALLNAFSWCLYGELNLPNASNIINEHAVNEIEDGEEVEALVTIQFKEKVKGSVAHEKHYSLTRSIKARKISEEQINYSEPEVRLEYREDGQSKLEVANIGIEINRILPEQLSSYFFFDGERIDNLSKESGTEEVKEAIKTMMGLEILERSILHTEGARKRFLTELKQYGDVETRNLVEEIENLHKQKEELESEEKEFKQYHKSIEKQIKEKEERLRQIEDSKRLQEQRDVKTKELNTSEEELVSTRKRLADLMSKQGYLAFSFLAIDKAQDVLANKNLNNNTYTGINASFLDQLIIQEECICGTHLITGSAEYNKVIDTKNYLAPISLEHAIAEFQSDVKITKDRKQKLFEGMGQLRLQESNFKQKIRLLNEAIEEIGKKISDKDSEEIVTLENVREQLITKKSQIDQRIGVIQHQLNEISEKLDKKNNEREKLNQKVEKAAVTEKRIKACEELIEVMKEIYKLREKIVKEQLQERVAKVYTKFLRKDYKIRLSNDYELDVINGNGNKVGMSQGERQITSLSFIGAIVDIAREQFNEKNINRFEEGGIYPIVMDSPFGALDSDHRERIAKGIPELSDQVIVIVSTSQWKGEVEEKMRDKIGKEYGLNYNDPRINKEKNYEFTEITEVVTK

SEQ ID NO: 13 - DNA, 1332 bp, Bacillus thuringiensis
atgaaggtaaatttgttaaaaaaaactcttatttgtatgtctttattaacaatccctatgtcttacaatacagtattcgctcatagcagcaacgaaataaaatctataggatattcaaatagaggattagaagataaattaatagattttaaagaagacaaagaaaaagcgaaagaatgggggaaagaaaaagcgaaagagtggaaactaaatgctgctgaaaaaacacaaattaataaatttctagatgatatggatggattaaaaacaaaatataaagaaattaatttttctaaaaacttcgactacgaaaaagagcttaaagagttagaaaagattaatgaaggactgaatagagccaatctaacaaattcaattgtcacttacaaaaatgtggatccagcaatgattggatttaataaatccttaactaatggagagcagattagttctgaaactttacaaaagtttaaagtacaatttttagggaaggatattaaatttgatagttatttggatacacaattaaatgagcaaaatattcttggtaaagaaagagttattttaaaagttaccgtaccaagtggtaaaagctcttctccaacaaaagcaggcgttattttaaataatggcgaatacaaaatgctaattgaaaatggatatttacttcatgtagaaaagatatcaaaaactgtaaagaaaggacatgagtatttgcaagttgaaggatctttaaaaaagagtctggactttaaaaatgatagcgatggtaagggagattcttggggaaagaaaaattataaggagtggtccgattttttaacagcagaacaaagagcagacttaaattattatggtcaaagagggtatactgagataaataaatatttgcgtgacgaaagtactgggaatactaatttagaagaaaaaataaaaaatatttctgaagcgctgaaaaaaaagccgatatctgaaaatattactgtttatagatattgtggaatgatggaatttggctaccaaattagtgaccctttaccttctgtaaaagattttgaagaaaagtttttaaatataattaaagaagaaaaaggatatatgagtacaagtatatctagtgatgcaacgccttttggaactagaagaattataatgagactgcaagtaccaaaaggaagtgcaggagcgtatgtaaatggtttagatggttttaagacatctgaaaaagagatgctccttgataaggggagtaaatatcacattgataaagttacagaagtaattgtcaaaggccaaagaaaacttgtagtagatgcaacattattaacaaaa

SEQ ID NO: 14 - protein, 444 aa, Bacillus thuringiensis
MKVNLLKKTLICMSLLTIPMSYNTVFAHSSNEIKSIGYSNRGLEDKLIDFKEDKEKAKEWGKEKAKEWKLNAAEKTQINKFLDDMDGLKTKYKEINFSKNFDYEKELKELEKINEGLNRANLTNSIVTYKNVDPAMIGFNKSLTNGEQISSETLQKFKVQFLGKDIKFDSYLDTQLNEQNILGKERVILKVTVPSGKSSSPTKAGVILNNGEYKMLIENGYLLHVEKISKTVKKGHEYLQVEGSLKKSLDFKNDSDGKGDSWGKKNYKEWSDFLTAEQRADLNYYGQRGYTEINKYLRDESTGNTNLEEKIKNISEALKKKPISENITVYRYCGMMEFGYQISDPLPSVKDFEEKFLNIIKEEKGYMSTSISSDATPFGTRRIIMRLQVPKGSAGAYVNGLDGFKTSEKEMLLDKGSKYHIDKVTEVIVKGQRKLVVDATLLTK

SEQ ID NO: 15 - DNA, 1041 bp, Bacillus thuringiensis
atgagggatttttttaaagataattacaataatattgagtttaataaaaatttaataaacttaataagtgaaataagtgaatataaggggaaattaaccgcctatcaagaacaagtgccccatatatttaaagatttgaaggaaaacattccctttcaatatgtaaaaaatttcaatgctatttatggggagaagaaagttactaataaaagattaaaggaactgttattttataatgcagtacctcaaactgtcattgaagattcagttttttgctatcatcaaactttttcctttataaataagaattattgcactttgtcgattagtccagaaaatatactagaattgcattttcaattaattaattatattacctcggatactgcaaaatggcgtgagaaaccaatttctatccttgggacaccggaaaaaggaattcctactatttgttatcgctctcttccacatacgcttataccacaaactatggagcaattatgtaatcaatataattatttaagtagtagtaagaaattacactcactattattgatagcatattttatgttaaattattactgcatagtaccttttaaccaaggaagtgaaaaactagcatttatgataatgaaattattattaataaaaagtggacatacatttgtacaatatatttgtttagataaatatattgagaagaatgaattagaatattatgactccctttataaatcatccgttaattggtactataatgagcataatactagcttttggctacaaacactattaattattgttttagaggcttatcaagatttgtatgatacaatagttgatttcatatgtaaacaaactaaatttgaacgtattcaagattttgttcttaaacaaaaacaaacttttacaaaagattatattcgtgacatgtatccagatatagctgagagtacaattaataaagcattagctactcttcacgatttagggcaaataaagttagtctctaaaggaagaacagcccattggataaaagtc

SEQ ID NO: 16 - protein, 347 aa, Bacillus thuringiensis
MRDFFKDNYNNIEFNKNLINLISEISEYKGKLTAYQEQVPHIFKDLKENIPFQYVKNFNAIYGEKKVTNKRLKELLFYNAVPQTVIEDSVFCYHQTFSFINKNYCTLSISPENILELHFQLINYITSDTAKWREKPISILGTPEKGIPTICYRSLPHTLIPQTMEQLCNQYNYLSSSKKLHSLLLIAYFMLNYYCIVPFNQGSEKLAFMIMKLLLIKSGHTFVQYICLDKYIEKNELEYYDSLYKSSVNWYYNEHNTSFWLQTLLIIVLEAYQDLYDTIVDFICKQTKFERIQDFVLKQKQTFTKDYIRDMYPDIAESTINKALATLHDLGQIKLVSKGRTAHWIKV

SEQ ID NO: 17 - DNA, 3291 bp, Bacillus thuringiensis
atggaatattggaaaagggggcgaaatgaaaaagaggcaagtatacctaagagaaaagatttgaagggggaaacttgcagcattttacagaaagaacagggggaaataattttgaaaaatatttacaagtgtttaacagtcacagcattactaacacaacttgcaacttttccaacagcatctttagcagaaaatgaaacacggcccgaaagtagaagcaacaaaagtgaacaaaatagtgttaatggtctaatgggacaatattttacagatgatgcattttctcaattggcatatattcaagtaggtgagcatagtgaactaatgaagaaaaacaaaatgcatgaagatgaaaaaaggattcaatctgtaaggtggttagggaaactaaaaccttctcaatcgggagaatatcaaatttctacatcgaatgatcaaaatgtaatattgcaaattaatggtgagacaatcgtaaatcaaaagagcgcggatcaatctattaagttagaaaaagatcaagagtatgaaattaaaatagagttccaaaataaagataataaagagttgcaattgttctggactatgaatcaatctgaaaaaataaaaattcctggtaaaaatatcatgtcacctgatttttctgcaaaggtaaatgtacctgataaccaaaaagatcagaaattaataccagaaagtaacctattcgataaaaaaggacaagctcgacaagcacctatgttggtagatacggataaggatggtataccggatgttttggaggaaaatggttacacgtttaaagataatcaaattgttccatggaatgaatcctttgcaaccgtaggatataaaaagtatatatcgaatccgagaagtgcaagaacagcggctgatccatatacagattttgaaaaagtaacaggacatatgccagcggcaacaaaagatgaagcaaaagatccacttgtagctgcatatcctgctgtaggggtagggatggagaaatttcatttttcgccaaatgaaaatgtatcagaaggaacttcaggtacgaaaacaaaaagtgtaacagatacaagtacaacatcaaatagtgtggatcttggtgggaaaatcggatttacaggaggagaaaaatcagcgtttagttttgaattttctccaaagtatacgcattcctggagcaatagtacttcaattcaaaatacagagagtgaaacttggtctaaacagattggcgttaatcccgcagaaagggcatttttaaatgcgaatattcgatactataatgcaggaaccgctccaatctatgatgtcaaaccaacatcaaattttgtacttcaacattcgggagcatcaatcgcgacgattacatcaggtccaaatcaaatcggcaatagtttagcaccaggggatacatatccgaaacgtggacaggcgcctatatctttgaatacagcaaatgaagcaggaacagttaaaattccaattaacggagagcaattggataaaatacaatccggtgatgagatattaaatcttgagactacgcaaaataaagggcaatatgcaacagtagattcaactggaaatccaacaacagatccatcaaggcagtgggatccaattcgcacaaacatcgatgctgtatcgggggcattaacattgaactttggaacaggaaaagatagtttagaacgaagagtggctgcaaaaaatccaaataatccagaggataaaacacccgaaattacaattaaagaagcaattaaaaaggcttttggtgcaaaagagaaagatggtagattgtatgttatggatcgaaatggaaaaaatatttggattgatgaatctgcagttaacttaatcggcgatgcgaaaacccaaaaagaaattgaaaatcagttaaaaaatatgccggataaaaaagtgtataatgcaaagtggaagcgtggtatgaaaatcacattacatattccaactgcctatcacgattttgaagccaatagtgcaggatggtattatacgtataaggacaatggaggatatacaggacaaaaacgtggtagaataggtgaaaatggaaacggatacacagtgagagacttggctttaaaaccgtatacaagttatactgcgagagcttatgtaagaacaggagtaagtactggaagtaatgatgttacattttatgtagataataaaattggttcaggaaaaggagcgaaaacgtctggtaaagtaacaggaaacaaatgggagatggtggagttttctttcaatactggagggaatccagagttcttttctaaaatcggttttcaaaataaagggaatgcgcaattacattttgatgatgtgtctgtaacagagtgggcacaaagtgaagatttgcaaaaagggcacagagtagaaacgtggcaaacctcatcatccaatcgtattgacggtgtgacattttcgaaattcccatcggcaaagttaaggtatcaattggagattgaagggacattcacagagattaggtcagatgcagtaacagatacgaatggaaagagatatttaaactttaataaatttaataataatcaagggattgataattataaaaaaattgcagtgtatgcagtagatgagaagaatgatcatctaaagatgaaattgcaggaaaatgaaccacagcaccaatttaagaattggaatatcgtgaatcatgtgaataaaaaatatgtgaatggtgttacattccgaaaaatcccaactgaagcggtgaattatcaattgaaagtgaatggtagttggacggcaattaaaccaggaaacactgttcaacctgatggttccaaatatcttaatttccttgaatttaatggtgggtatggatatgcagaaagtacttctattgaagtgtgggctgtaaataaatccaataatacgaagaaaacaaaaatagctcattataataataaagagacattagtggcaacagtttcatctaattcttcgccatcgccagggcaaaaaaataggtcaagtcaaaactttactattagtaatttaccggctggaacgaaagggttgaaatgggtagtagaaccaacaacgccagattcggtatcaaatattcgatttaaacttatgcgtgatgtaagtggaggtacagacccagttatttggaatgatttgtttaatcaaaaaacaacagatattcaaacgagttctaaattttatatttcaaacccacagggagcgtctaaaaactttactgtaaaggtatatgcgatttcgaat

SEQ ID NO: 18 - protein, 1097 aa, Bacillus thuringiensis
MEYWKRGRNEKEASIPKRKDLKGETCSILQKEQGEIILKNIYKCLTVTALLTQLATFPTASLAENETRPESRSNKSEQNSVNGLMGQYFTDDAFSQLAYIQVGEHSELMKKNKMHEDEKRIQSVRWLGKLKPSQSGEYQISTSNDQNVILQINGETIVNQKSADQSIKLEKDQEYEIKIEFQNKDNKELQLFWTMNQSEKIKIPGKNIMSPDFSAKVNVPDNQKDQKLIPESNLFDKKGQARQAPMLVDTDKDGIPDVLEENGYTFKDNQIVPWNESFATVGYKKYISNPRSARTAADPYTDFEKVTGHMPAATKDEAKDPLVAAYPAVGVGMEKFHFSPNENVSEGTSGTKTKSVTDTSTTSNSVDLGGKIGFTGGEKSAFSFEFSPKYTHSWSNSTSIQNTESETWSKQIGVNPAERAFLNANIRYYNAGTAPIYDVKPTSNFVLQHSGASIATITSGPNQIGNSLAPGDTYPKRGQAPISLNTANEAGTVKIPINGEQLDKIQSGDEILNLETTQNKGQYATVDSTGNPTTDPSRQWDPIRTNIDAVSGALTLNFGTGKDSLERRVAAKNPNNPEDKTPEITIKEAIKKAFGAKEKDGRLYVMDRNGKNIWIDESAVNLIGDAKTQKEIENQLKNMPDKKVYNAKWKRGMKITLHIPTAYHDFEANSAGWYYTYKDNGGYTGQKRGRIGENGNGYTVRDLALKPYTSYTARAYVRTGVSTGSNDVTFYVDNKIGSGKGAKTSGKVTGNKWEMVEFSFNTGGNPEFFSKIGFQNKGNAQLHFDDVSVTEWAQSEDLQKGHRVETWQTSSSNRIDGVTFSKFPSAKLRYQLEIEGTFTEIRSDAVTDTNGKRYLNFNKFNNNQGIDNYKKIAVYAVDEKNDHLKMKLQENEPQHQFKNWNIVNHVNKKYVNGVTFRKIPTEAVNYQLKVNGSWTAIKPGNTVQPDGSKYLNFLEFNGGYGYAESTSIEVWAVNKSNNTKKTKIAHYNNKETLVATVSSNSSPSPGQKNRSSQNFTISNLPAGTKGLKWVVEPTTPDSVSNIRFKLMRDVSGGTDPVIWNDLFNQKTTDIQTSSKFYISNPQGASKNFTVKVYAISN

SEQ ID NO: 19 - DNA, 774 bp, Bacillus thuringiensis
atgatctatagaagaggagaattaaaattgaaaccaactagagaaaagtacgtaattaatggggagtacacaatagaacgtaagcttttacataatgaaatcattaaattatttctaaatgatcaaccgcagcaagagcaagaacctgaggctatattacttggtggtggttctgctgctggaaaaagcccaattggagagttagtaagtaagggatataaacatcagaaacaaaacatggtttggatagatcctgataagatcaaagaaaaaataccagaatatcaagagttaatagaatccggaaacattgagttaataaaacaagcagcttttttagttcatgatgaaagtagtgatattaccatgaaacttttaaaaatctgcatgaaaagaaaaataaactgtatgtatgatggtacaatgaaaaatgaagtaaaatacaaaaagttaattcaacaattaagactagcaggttttagtattaaagcaattattgtagatgttccaatcaaggttgccttagagcgatccaatttgcgttttaaagtaacaggaagattggtaccccaaagtataattgaagaaagccatatgaaagtagcgactactttttctaaaattaaagatttaatagattgctatactttatatgataatacagggaaggaaccagaagtttttgcttttaaagaatcaaaacgagtaaaagaaattattgttgatgaatgtagaaataatcaatttatcgagaaatcagctcttgttttcaag

SEQ ID NO: 20 - protein, 258 aa, Bacillus thuringiensis
MIYRRGELKLKPTREKYVINGEYTIERKLLHNEIIKLFLNDQPQQEQEPEAILLGGGSAAGKSPIGELVSKGYKHQKQNMVWIDPDKIKEKIPEYQELIESGNIELIKQAAFLVHDESSDITMKLLKICMKRKINCMYDGTMKNEVKYKKLIQQLRLAGFSIKAIIVDVPIKVALERSNLRFKVTGRLVPQSIIEESHMKVATTFSKIKDLIDCYTLYDNTGKEPEVFAFKESKRVKEIIVDECRNNQFIEKSALVFK

SEQ ID NO: 21 - DNA, 2967 bp, Bacillus thuringiensis
atgaagaaaaacaaaatgcatgaagatgaaaaaaggattcaatctgtaaggtggttagggaaactaaaaccttctcaatcgggagaatatcaaatttctacatcgaatgatcaaaatgtaatattgcaaattaatggtgagacaatcgtaaatcaaaagagcgcagatcaatctattaagttagaaaaagatcaagagtatgaaattaaaatagagttccaaaataaagataataaagagttgcaattgttctggactatgaatcaatctgaaaaaataaaaattcctggtaaaaatatcatgtcacctgatttttctgcaaaggtaaatgtacctgataaccaaaaagatcagaaattaataccagaaagtaacctattcgataaaaaaggacaagctcgacaagcacctatgttggtagatacggataaggatggtataccggatgttttggaggaaaatggttacacgtttaaagataatcaaattgttccatggaatgaatcctttgcaaccgtaggatataaaaagtatatatcgaatccgagaagtgcaagaacagcggctgatccatatacagattttgaaaaagtaacagggcatatgccagcggcaacaaaagatgaagcaaaagatccacttgtagctgcatatcctgctgtaggggtagggatggagaaatttcatttttcgccaaatgaaaatgtatcagaaggaacttcaggtacgaaaacaaaaagtgtaacagatacaagtacaacatcaaatagtgtggatcttggtgggaaaatcggatttacaggaggagaaaaatcagcgtttagttttgaattttctccaaagtatacgcattcctggagcaatagtacttcaattcaaaatacagagagtgaaacttggtctaaacagattggtgttaatcccgcagaaagggcatttttaaatgcgaatattcgatactataatgcaggaaccgctccaatctatgatgtcaaaccaacatcaaattttgtacttcaacattcgggagcatcaatcgcgacgattacatcaggtccaaatcaaatcggcaatagtttagcaccaggggatacatatccgaaacgtggacaggcgcctatatctttgaatacagcaaatgaagcaggaacagttaaaattccaattaacggagagcaattggataaaatacaatccggtgatgagatattaaatcttgagactacgcaaaataaagggcaatatgcaacagtagattcaactggaaatccaacaacagatccatcaaagcagtgggatccaattcgcacaaacatcgatgctgtatcgggggcattaacattgaactttggaacaggaaaagatagtttagaacgaagagtggctgcaaaaaatccaaataatccagaggataaaacacccgaaattacaattaaagaagcaattaaaaaggcttttggtgcaaaagagaaagatggtagattgtatgttatggatcgaaatggaaaaaatatttggattgatgaatctgcagttaacttaatcggcgatgcgaaaacccaaaaagaaattgaaaatcagttaaaaaatatgccggataaaaaagtgtataatgcaaagtggaagcgtggtatgaaaatcacattacatattccaactgcctatcacgattttgaagccaatagtgcaggatggtattatacgtataaggacaatggaggatatacaggacaaaaacgtggtagaataggtgaaaatggaaacggatacacagtgagagacttggctttaaaaccgtatacaagttatactgcgagagcttatgtaagaacaggagtaagtactggaagtaatgatgttacattttatgtagataataaaattggttcaggaaaaggagcgaaaacgtctggtaaagtaacaggaaacaaatgggagatggtggagttttctttcaatactggagggaatccagagttcttttctaaaatcggttttcaaaataaagggaatgcgcaattacattttgatgatgtgtctgtaacagagtgggcacaaagtgaagatttgcaaaaagggcacagagtagaaacgtggcaaacctcatcatccaatcgtattgacggtgtgacattttcgaaattcccatcggcaaagttaaggtatcaattggagattgaagggacattcacagagattaggtcagatgcagtaacagatacgaatggaaagagatatttaaactttaataaatttaataataatcaagggattgataattataaaaaaattgcagtgtatgcagtagatgagaagaatgatcatctaaagatgaaattgcaggaaaatgaaccacagcaccaatttaagaattggaatatcgtgaatcatgtgaataaaaaatatgtgaatggtgttacattccgaaaaatcccaactgaagcggtgaattatcaattgaaagtgaatggtagttggacggcaattaaaccaggaaacactgttcaacctgatggttccaaatatcttaatttccttgaatttaatggtgggtatggatatgcagaaagtacttctattgaagtgtgggctgtaaataaatccaataatacgaagaaaacaaaaatagctcattataataataaagagacattagtggcaacagtttcatctaattcttcgccatcgccagggcaaaaaaataggtcaagtcaaaactttactattagtaatttaccggctggaacgaaagggttgaaatgggtagtagaaccaacaacgccagattcggtatcaaatattcgatttaaacttatgcgtgatgtaagtggaggtacagatccagttatttggagtgatttgtttaatcaaaaaacaacagatattcaaacgagttctaaattttatatttcaaatccacagggagcgtctaaaaactttactgtaaaggtatatgcgatttcgaat

SEQ ID NO: 22 - protein, 989 aa, Bacillus thuringiensis
MKKNKMHEDEKRIQSVRWLGKLKPSQSGEYQISTSNDQNVILQINGETIVNQKSADQSIKLEKDQEYEIKIEFQNKDNKELQLFWTMNQSEKIKIPGKNIMSPDFSAKVNVPDNQKDQKLIPESNLFDKKGQARQAPMLVDTDKDGIPDVLEENGYTFKDNQIVPWNESFATVGYKKYISNPRSARTAADPYTDFEKVTGHMPAATKDEAKDPLVAAYPAVGVGMEKFHFSPNENVSEGTSGTKTKSVTDTSTTSNSVDLGGKIGFTGGEKSAFSFEFSPKYTHSWSNSTSIQNTESETWSKQIGVNPAERAFLNANIRYYNAGTAPIYDVKPTSNFVLQHSGASIATITSGPNQIGNSLAPGDTYPKRGQAPISLNTANEAGTVKIPINGEQLDKIQSGDEILNLETTQNKGQYATVDSTGNPTTDPSKQWDPIRTNIDAVSGALTLNFGTGKDSLERRVAAKNPNNPEDKTPEITIKEAIKKAFGAKEKDGRLYVMDRNGKNIWIDESAVNLIGDAKTQKEIENQLKNMPDKKVYNAKWKRGMKITLHIPTAYHDFEANSAGWYYTYKDNGGYTGQKRGRIGENGNGYTVRDLALKPYTSYTARAYVRTGVSTGSNDVTFYVDNKIGSGKGAKTSGKVTGNKWEMVEFSFNTGGNPEFFSKIGFQNKGNAQLHFDDVSVTEWAQSEDLQKGHRVETWQTSSSNRIDGVTFSKFPSAKLRYQLEIEGTFTEIRSDAVTDTNGKRYLNFNKFNNNQGIDNYKKIAVYAVDEKNDHLKMKLQENEPQHQFKNWNIVNHVNKKYVNGVTFRKIPTEAVNYQLKVNGSWTAIKPGNTVQPDGSKYLNFLEFNGGYGYAESTSIEVWAVNKSNNTKKTKIAHYNNKETLVATVSSNSSPSPGQKNRSSQNFTISNLPAGTKGLKWVVEPTTPDSVSNIRFKLMRDVSGGTDPVIWSDLFNQKTTDIQTSSKFYISNPQGASKNFTVKVYAISN

SEQ ID NO: 23 - DNA, 990 bp, Bacillus thuringiensis
atgtcaataattgacttttcaaaaaaagcatatgaatttatagattggcatgcaaatacccaaaatcctcacaaacctaagaatcacgaccacattatatatccgtatgcctacgatgcatactcagaggtacaacaaaaaacttttcatataggaaatcccaccccagttgctggagcttttagggtaattgaaaataatagtgatgtacaacaaaagcaaactgttaaattttctgaaaaaacagtcaatacagtcacacataccactgtgaacggttataaagtaggaggtggaatcaaaagcaccacaaaagcatctctagaatgttcatttatagcagcaggtaaactagagcaatctgttgaagtctctgtaactggtgaatataatcatagttccacagatactaatacaaataccgttgaaaaagtatgggaattaactgaggaagtacaggcccctcctaagtcacgtatagttgcaaggcttgtaattatgagagcaaaaatacaagtacctgtaaaattgacgacttatctgtatggtacaactagaaaagaagaatataactttccggcacttgtaggttatgattatgattatgatgcatctagaaattactaccctacctggtgggattttgccggttattcgctaggagcagcaaattggcctggtaaacctgaaagtttttcttacaaagagggggatccttcgcttattattactggggaggggataacaactgttgatttagggctgtatgttactactagatacgatcaattcccaatatcttctcctaattattatgaagtatcatctgatagtaatttagatcctttatttagtcatactgggtcctatgattgtattcctactgaagccgctaatggctcttctgattgctcaggaaatacagatgcaactacatggtattctaaaaacatattactagcagatggaagaataataaaagttcgtaaa

SEQ ID NO: 24 - protein, 330 aa, Bacillus thuringiensis
MSIIDFSKKAYEFIDWHANTQNPHKPKNHDHIIYPYAYDAYSEVQQKTFHIGNPTPVAGAFRVIENNSDVQQKQTVKFSEKTVNTVTHTTVNGYKVGGGIKSTTKASLECSFIAAGKLEQSVEVSVTGEYNHSSTDTNTNTVEKVWELTEEVQAPPKSRIVARLVIMRAKIQVPVKLTTYLYGTTRKEEYNFPALVGYDYDYDASRNYYPTWWDFAGYSLGAANWPGKPESFSYKEGDPSLIITGEGITTVDLGLYVTTRYDQFPISSPNYYEVSSDSNLDPLFSHTGSYDCIPTEAANGSSDCSGNTDATTWYSKNILLADGRIIKVRK

SEQ ID NO: 25 - DNA, 5175 bp, Bacillus thuringiensis
atggtcaaaatattccgaaaaaaaaggtgtatgtccctgatttcgaaacagggacaggcattaccaatctttcagctcatttatttgacggaggcgaaattcatggcgaatagagttaattgtaaaaaattccctaatcatccaggctgtaagaaaacacctacaacacctacaacacctggaacacctacaacacctggaacacctacaacacctaaaaaggacccattcaaggaatatcccaagctaaaccaagacatacaaaaactattagaaatcgatagcgatggggatggaatccctgatgccctagaaaagaatggttatacaatttctgaagtatttgaccaggaacatggctattttaatgtcatgccttggtccgaaacatacgatcataatcctgatttttataatcatcaccccaaatatatttcgaacccctttgacaagaatacggtaggggacccttacacagatttagaaaaagcaggccgaagcatctatatagaggggagcatattaccggaagcctatcatccattagtagctgcttgtccaagtgttgcaacatttatggaggggtttattttaaaagatgtgcaagacaaagaaaataccagcacaactggtcattcttatcatacaagttatggatttgaagatacgagaacggttggaagcggaacagatttagccaatgcaggaaagctcgagttcggcggaaaaggcgtaaaaaatggaaaaagtggagaacagggaggcgaaacatcaaacatttcaggttccgtgcacctttctaggaacttaaaacaccatacgaatgaacaacaaggggtgacaacaatctcctccttgcaagaagctcatcaacaaactaccgaatcatcaacaaccattcattcggcaagtgctgccatcttacaaggaattgttcgttatcagaatatgggaaccgctaagattagtaatatgcgtccgacactaaattttcaagtggaagaccgaccgttgttcacgtataaagtacctgacggagtagaaaaattaagtccgggagacagctacccatctttagatgcaacaggagcaatcgttacaccgggcgattcatttcaaggacatccgtctaccatcgatacaggagcgaaaaagaagctggcagaaggaaaaccattgaaagtcgtgacaactcaaattgacggaacattcaaggccacagctggttcgggaaagtatgccccaggaagagaggtagagtggtcccaagttacagatacaatgatgcagcgcacagcacgtatactcttagaaacaccaaatgaaacgctagatagaagagtcgcggctccttccacagatgaggttgttggaacacccgacaaaatgaaaacagaatcgggtataccgcgaattacagtggaacaagccatccaatttgcctttggagccaaaaaagataatcgcgggaacctcgtcatgacaacacaacaagggctgacgtataaaatcgatcgttcccatgtagctttgcatatgaatcaaaaaacagatgcattaatctcgaaacagctgcaggcttttaaggacaaaggcgacgacacgaaaagtgtatacgatgtgactctcacgaaagagatggttattttaattaaacctattttagaagtgaatgcttttttaaataataactatttatatatagaaaattacttcgaccagagcttgtcgtatagtgtatggaaaaacacgggaacaagcagcgagctactgaaacaaggaattgtaccgtctgcttccacgataggaaccgggtacctatgtgataatccggctgaagagttacacatttcggtgtcaaaacacgtatcacaagttatttttaaggggaaagtttcaagtttacgagggtttaatcggaaagaagaaaaagaagaaaaactattaccgatacaacaatgttttggaaaatgtaaaggttttacaaaggaggaattaaaatcctccaccccccctgtgatgtattggcttacggattacggtgatgatacatggtggagattggattataaaaccagaagaaatcgtaacctcacaattttatacagaagaaaattagaagatgagacgaagcaatctagagaagctgaattgggaactgatagagaggtgcttctgtttaagaaaacagaaggattagatcctgatgataaactttctgtccaaatagacggaggtaaaaaatatggtttaaactcacattttgattttaaccattggctagaagtacctcccgggaatgaaaggatatttgatctaaacctatctataagatatctaaaatatgattataataaaatagtagaggatagagtagaaaacttaggacctatcaaggttcctaacaggaaattttatacacaagaacatagactttctaaaactcaagtgaaaatttcagaaaaaaagaaggttctattatatcaaacaagtgattctggtgaaatatgtttgcttaataaacaactggaaaccgtctcttattgcatacaaacgccttatcaagaatggatatggaagggggagttgcgtccattcgagatattaaaattcactaaaggcaatccgattattccaaaacgctataaatttggtaccttccaaccattaatgtctgatgaaataattattaccattgatgatataccaattttttatggaatcccagaacgagattttgtgtataaggaaaaaatagataccttgcagaaagtttgtttagattattggcattttaatgaaaataatggtcatcagacttatgattatgtaagttttaaaccactaaatggtgaacttattaacactgtgagggattttgaactcatagttgagcacaatagtattggaaaacattccacacgtcctttagaattaaacggaaaattgattgttaatttctttgattacacaggtgatacaaatcagcatccaagaaaaggacagcaggtagatattattgctcatgatatatttggaaatacacatactgtatttagtggaaaagctgaattaacagatgctttatggaaagcacaatataaggtaagtgagtggcataaaaaaggtgaacagtttgatgccttatacctttctcctataccaactggccttacagaggatgtaaagtcatatgatatacagattaatcaggatatatacaagtctgtttcatttgaacgtcaagataatggtggatatgttcgagatcaacgattgaaattagatttttctaatagtaaattctctcaggaaaaacttccaagattaggagattctattaaattaactattcatacaatggatgataagcgtgttgaaattgatttaggaaaagtagaggaatgtactaatccagacagtattaatattttggaaagggtacatgagattacagaatggactaaaaaaggtaatcattatacatgtgtacattttaaagaaggaaataaagaagaggaaaaggcacagatagatcatagtaaaagctatgtatcaagctatttgtttaaagtgaataatcgttattatggagaaatttctataagtaacgaaacacaaaaattggatttaacggaatgtaataacaatatgaagatacaaaaaggcgactatgttgaaatctatgcgtataaaaaagatggagaaggagtactcattcaaagtcgatatgctggcaccacaggccttctaggagagtatccgatagaagatagtatgaataatgcatgtgttataacaagttggtctaaaacaaacaattcatatacttcatttacaatagatcaattgtcagacccagttgatagttatattaaaaagtatgagggacatattaacaataaagtagtgaatttgactcagaaagataaaacatttgcatttgatgcacaacaagccccgcgtcatggagatatcgttcaaatcaacgcatatacgtatacagggaaagtgattaaattagcgggacggcttgcgggagctactggtccggtagatgataaggacgtttgctctattcataaaataaaaggttgggaaaatgagaataagacgattgttttcgatacaagtgaattgaaagattccatacaagcgcatatacaatcatatacaattgaagtttggaaaggtgctaataccccatgggaatcttttggtaatccaatttatataaatgaaaagggagaattgcatttacaagattgtaatgcaaataaaccatttcctcagcatcctaacgtagtaaaagttattgctaatttgtttgaatctaaaagaaaagtaagcgtcatggtaagaaaagtaggcgtaacaaacccacctccgactgaacaggacattcttacagcacacaaaaatttcaactgggactttgagagggagaagttaaagtcgattacattccctcaagtagatagtgagttggcaagttatatttcttcttatcaaataaagaaatggtcaaatttgataacagagaaaactgcattcaaagtcaaagaaaacaaaggactaactgtaacctttgagaatgcgattgatgtgactagcctgcagaaaattgctgtagggaatgggaaaacggaagaaagaaaggtacaagatgagatttccgcttatgcccattgtattaacataggagaaaaaacagaactcaaaccaattttagttataggaacgtatgaaggagcaaaaaatgtaagaggagtcaagcctgaacgccctatatcaaaagaagatattgtaaaagcacatcaaatagagaactgggtttacgattggaatggaactcatgttactgtattttacttcaataaacagttgcaaccatatttaacggatatacaatactatagtatccaaattaatggtacggaacatcttcctccagattacgttaaaagtcaagatttatctttggaaacagaggaaggcaaggacgggaaagcaaacggaccacaaggccttccaattagatttaatacgtttaatctgactggtggagttggaaaagaactgccaagtccaggggatacattagatgtaactgcgcatttaaaagataactcctcattgaaagtaattaaaaattacacaattccatctaacaag

SEQ ID NO: 26 - protein, 1725 aa, Bacillus thuringiensis
MVKIFRKKRCMSLISKQGQALPIFQLIYLTEAKFMANRVNCKKFPNHPGCKKTPTTPTTPGTPTTPGTPTTPKKDPFKEYPKLNQDIQKLLEIDSDGDGIPDALEKNGYTISEVFDQEHGYFNVMPWSETYDHNPDFYNHHPKYISNPFDKNTVGDPYTDLEKAGRSIYIEGSILPEAYHPLVAACPSVATFMEGFILKDVQDKENTSTTGHSYHTSYGFEDTRTVGSGTDLANAGKLEFGGKGVKNGKSGEQGGETSNISGSVHLSRNLKHHTNEQQGVTTISSLQEAHQQTTESSTTIHSASAAILQGIVRYQNMGTAKISNMRPTLNFQVEDRPLFTYKVPDGVEKLSPGDSYPSLDATGAIVTPGDSFQGHPSTIDTGAKKKLAEGKPLKVVTTQIDGTFKATAGSGKYAPGREVEWSQVTDTMMQRTARILLETPNETLDRRVAAPSTDEVVGTPDKMKTESGIPRITVEQAIQFAFGAKKDNRGNLVMTTQQGLTYKIDRSHVALHMNQKTDALISKQLQAFKDKGDDTKSVYDVTLTKEMVILIKPILEVNAFLNNNYLYIENYFDQSLSYSVWKNTGTSSELLKQGIVPSASTIGTGYLCDNPAEELHISVSKHVSQVIFKGKVSSLRGFNRKEEKEEKLLPIQQCFGKCKGFTKEELKSSTPPVMYWLTDYGDDTWWRLDYKTRRNRNLTILYRRKLEDETKQSREAELGTDREVLLFKKTEGLDPDDKLSVQIDGGKKYGLNSHFDFNHWLEVPPGNERIFDLNLSIRYLKYDYNKIVEDRVENLGPIKVPNRKFYTQEHRLSKTQVKISEKKKVLLYQTSDSGEICLLNKQLETVSYCIQTPYQEWIWKGELRPFEILKFTKGNPIIPKRYKFGTFQPLMSDEIIITIDDIPIFYGIPERDFVYKEKIDTLQKVCLDYWHFNENNGHQTYDYVSFKPLNGELINTVRDFELIVEHNSIGKHSTRPLELNGKLIVNFFDYTGDTNQHPRKGQQVDIIAHDIFGNTHTVFSGKAELTDALWKAQYKVSEWHKKGEQFDALYLSPIPTGLTEDVKSYDIQINQDIYKSVSFERQDNGGYVRDQRLKLDFSNSKFSQEKLPRLGDSIKLTIHTMDDKRVEIDLGKVEECTNPDSINILERVHEITEWTKKGNHYTCVHFKEGNKEEEKAQIDHSKSYVSSYLFKVNNRYYGEISISNETQKLDLTECNNNMKIQKGDYVEIYAYKKDGEGVLIQSRYAGTTGLLGEYPIEDSMNNACVITSWSKTNNSYTSFTIDQLSDPVDSYIKKYEGHINNKVVNLTQKDKTFAFDAQQAPRHGDIVQINAYTYTGKVIKLAGRLAGATGPVDDKDVCSIHKIKGWENENKTIVFDTSELKDSIQAHIQSYTIEVWKGANTPWESFGNPIYINEKGELHLQDCNANKPFPQHPNVVKVIANLFESKRKVSVMVRKVGVTNPPPTEQDILTAHKNFNWDFEREKLKSITFPQVDSELASYISSYQIKKWSNLITEKTAFKVKENKGLTVTFENAIDVTSLQKIAVGNGKTEERKVQDEISAYAHCINIGEKTELKPILVIGTYEGAKNVRGVKPERPISKEDIVKAHQIENWVYDWNGTHVTVFYFNKQLQPYLTDIQYYSIQINGTEHLPPDYVKSQDLSLETEEGKDGKANGPQGLPIRFNTFNLTGGVGKELPSPGDTLDVTAHLKDNSSLKVIKNYTIPSNK

SEQ ID NO: 27 - DNA, 4764 bp, Bacillus thuringiensis
atggcaacaaccaattctgtttcacaaaattctttcgatttagcgcccctagggttatatggaattttttacaaaaaagctctttttcaggacatgatactaggggttcaaggagaaaatgatggagggatttttcattttatgagccctcaaaagtatcaatcagatttgcatctcacttcttttgaatcagcgagatgggttggaagactgaaaatctctgaagcgggtgattatcttttttcttcatccgataaatggcgttcttgtatgaaaatttggaagcaagttacatttcaagtttccccaaaggtactgaaacaaatgaaatgcacagaagataaggacgacaaaatatatacgattccggaaaaaacagatcctaatgcgaagaatgcctttcgtgtaacatgtaagcaaggcgtgtatcaggtgttaaaagaagacaatgaggatgacaattggaatgtggagatacgtgtacctaagacatcgaatggagaaacgtatagcggaacaatttcatacctgatgcaacaaggagatctgactggtcatctagaggaaggcatctataaaattcgagttgaatatatgccacttataccaatagtagcgaatgaaaacatctttacattatattggcaaactcctacaattctaaagaaatcaggaggagatcctgctaagaatacggtaatccctacggaaaatttaagaggacccgattgtttagattcagattatttccctacacatattaccgataatttatttaatagtaagcaatatatgattcttgattcagaggaaatacagtctttggtatctagtaatcagcatcctgaaacacaaaccattgtctcatataaccgtatatcagcagataccgagttgacagatgaatctaacacagatgagtccaaaggagcggatagggccatcaacataacattagatcaactgaaagctatgacgcttatacaaaatcgtatcaagcagattgggaacgatcaaaatgtgatggaagagcaaatgaagcgttgggcgaaagcgcgcaaggatgaaaatatagctttcaatatggaaacgatgatacaaatgctctggaaagagaaagcacctaagttcattcagcagttaaagaattctctttcgatactacaaaaacaaacatccaaaaatctaatttccactcttcaagatcttattaaggacataaacccacaaacaaataagttcaagatcgagttactggaaaaattcatttcggagttagatgctttttataaagaagaaagtactttgatgaaaaactcatcggaattatctagcacggtgtctatccttaagacaatactagaggacatgaaggagttgcatgcaagtcagacgcaaacttcggaggcagctatagctgcctggaataaggaatatgtatataatgaggaccctaagaagaatttagacccggattatgatgtaacaaatccacatgcattttatgccgatgcgaataatgacgggataaccaattatgattctatgcagggttttacggttacatccgatggacaaatacagccttatggaatgaggaaggattttccaacctattattgtaattatcgtcttaaaagcacaacaggagatccgtttacagacacgaataaattaatcggttccggtaccgttgaacgagtggctaatatatcagaattggcacgaaacccgttagtagcagcgtatccacatataaatgtgaacatggttggttttcagttaatcccagaaatcactaagactgaaggagtcgcaaaaacctattcattttctgtaagtaattctcgaacagattcgcagacaactagtactgggcaaacacatggaacggaagaggcgatacacggagagatatcaatatcagaaaacccctcaattggagggggaggctcgaagagttggtcgaacagcttatcaaatgagatgtccacttcaaacactacagaagtaaacaccaccaatggcaaagatgagtctacgtcttttcaaaagagttttaacacagcaaattacgcgatgtttaatggtttggtaagatatcgaaattcaggaactgctggtgtcagtaagttattaccaaccttcaattttaattaccatgatggaaataaaatggaacctcttgttactgtgaagccagcaaaagatggatcggcagaagtcggattacttcagccagatgcctcgtatcctcctgatgatcagaaaacccctttagttattaaatcaactgatgcttttaatgcaaatcaaattcaggcgtctcaatcacaagttcaggccatattgtcagggcgcccaatgagtttaagtttgctacaatatgatggttatataccaaatggggagccaacttccaatacccgatgggtacagcatttagataaaatacaagagcatacagcctattggaccctgattacaccggagggggacatgtatgatagacgaattgcagcaccaagagagaacgatttaggatacaagggcatcaatccagacaaactaggcaaacttcccttctcttatgaagatatcgataaagctcatcgcttgacaattggagaggccataacacttgcattcagtgatgatccatcacaaaaatttgtgaaaacaaataagaatggaattaagtatgatttgcaatcaaagaatgtgaaaattacgatgtctaggcagaccaaagaggctctaaagaaacaactggattttgcaaagacggaggtagaagaaacacaatttcatttgaaaaagttagagcgggatgaagcagaacaatacaaaaagatagagaatgaatttaagaagttacaaatgaaagacgaagatagaaaagaatggttatacaatttccatcagaacaaaccggtacaaaaaaaactggaaacccttgaacaaaacaaacaatttataggggatcaactcgagcatatcaaaccaaaaagcgacaaaggtttgcaacttgccgcagcggatgtcaacaaacttcaaacacaacttgaccagataaatgacgcgattgacaaactagaggcagaacagatggggtatcaagagaagatggacaatcttctgaagcaggtaggaaaaacgttgaatcaaaaacaaattgatgattggacaaaaaagataacaaaaaagatagcaaacatggatcttgtacaagagtggattcagcagcaacgtgcaaagggacaggcctatttgggcgaaatgaagaagacgctcgaaaaaaagaatttttatgattatgaacttctacaaggaatgcgcttgattatacaaattccacctattgtaacggcaacattcaaaaatgctaccacagaagataagcacacgtatcaagaactgtacctgaaaaatcatttcctacaagaaaagctaaagtatcacattaaattacttccgccttcatcgacaacaacgctaaaagatgcgccaaaattgggttcttttactccagctacagaaaagaacgtatttggatataaagaaggggtactagaaccaaacgcagagcaaaatacgaagattccacatctttctaataacgatcggattgaagtgtggattcaaaaagatggagaaaaagactatagccttctgatttcaaaaacggtaggacaaataccaggtttccgagctgacaagccaaaagtaaacacaacaaaactgacagagaacttcacattccagacatttaaagtggattggtcttacccgaaagcgtgtaatggcgtagcactctctattccttcccctgatatattaaaagagtttctatcctttacattagaggtaacggaccctactaccaacaaaacggctagttatggacctgtactggcatcagaaataagaaaaaatattgtacctgaaaagaacgcggcaaaacagagctgtacctttgacttttctctttttaaggaatttgatatgaaaaaaaattactggggatatatgttcacactgaaaggaaaattagatgaagcggtaccgagcggttgggaaaagaaacaacctgtttctcgtcctaaagatgagaagggcaagatgaaaaacggtgttacattagtacctacatttgaagagccgaggacaattgagttatgtaaacaaattttccctggaaaaatgtttagtctagaacagtatatgaacgcttttaaaaataaaggaacactttctagtcctctaacaaatcagaagtcaaaagtaaatggggaccatgtcacatttaatagcgtatatccggaattcgtaattgaaagacagggagaactttctaattatccacttcttcttgctggtattaaaaaagttacttgcatctttaagaacacggcaaagacagaagtaatcactccaaccgacacacagtttacaatgaagaataatgcattacatgtctgctttaataccaaaatagatgtaacacaaaaagaagaacctgacggatggaaagttgcaggagaggttgggaaaggcgctttattaagcgccttgattccctcatcagtcgagaatattaagcatgaattcaataaatacagcacatataatgcagaagtagacggtttgatcaagtcagacaaatacgataaaatctttaaggttcagcttactgtggataaagatatattgacagataacaatcacaaagatcaagtgtttacgattttcgagacaaagata

SEQ ID NO: 28 - protein, 1588 aa, Bacillus thuringiensis
MATTNSVSQNSFDLAPLGLYGIFYKKALFQDMILGVQGENDGGIFHFMSPQKYQSDLHLTSFESARWVGRLKISEAGDYLFSSSDKWRSCMKIWKQVTFQVSPKVLKQMKCTEDKDDKIYTIPEKTDPNAKNAFRVTCKQGVYQVLKEDNEDDNWNVEIRVPKTSNGETYSGTISYLMQQGDLTGHLEEGIYKIRVEYMPLIPIVANENIFTLYWQTPTILKKSGGDPAKNTVIPTENLRGPDCLDSDYFPTHITDNLFNSKQYMILDSEEIQSLVSSNQHPETQTIVSYNRISADTELTDESNTDESKGADRAINITLDQLKAMTLIQNRIKQIGNDQNVMEEQMKRWAKARKDENIAFNMETMIQMLWKEKAPKFIQQLKNSLSILQKQTSKNLISTLQDLIKDINPQTNKFKIELLEKFISELDAFYKEESTLMKNSSELSSTVSILKTILEDMKELHASQTQTSEAAIAAWNKEYVYNEDPKKNLDPDYDVTNPHAFYADANNDGITNYDSMQGFTVTSDGQIQPYGMRKDFPTYYCNYRLKSTTGDPFTDTNKLIGSGTVERVANISELARNPLVAAYPHINVNMVGFQLIPEITKTEGVAKTYSFSVSNSRTDSQTTSTGQTHGTEEAIHGEISISENPSIGGGGSKSWSNSLSNEMSTSNTTEVNTTNGKDESTSFQKSFNTANYAMFNGLVRYRNSGTAGVSKLLPTFNFNYHDGNKMEPLVTVKPAKDGSAEVGLLQPDASYPPDDQKTPLVIKSTDAFNANQIQASQSQVQAILSGRPMSLSLLQYDGYIPNGEPTSNTRWVQHLDKIQEHTAYWTLITPEGDMYDRRIAAPRENDLGYKGINPDKLGKLPFSYEDIDKAHRLTIGEAITLAFSDDPSQKFVKTNKNGIKYDLQSKNVKITMSRQTKEALKKQLDFAKTEVEETQFHLKKLERDEAEQYKKIENEFKKLQMKDEDRKEWLYNFHQNKPVQKKLETLEQNKQFIGDQLEHIKPKSDKGLQLAAADVNKLQTQLDQINDAIDKLEAEQMGYQEKMDNLLKQVGKTLNQKQIDDWTKKITKKIANMDLVQEWIQQQRAKGQAYLGEMKKTLEKKNFYDYELLQGMRLIIQIPPIVTATFKNATTEDKHTYQELYLKNHFLQEKLKYHIKLLPPSSTTTLKDAPKLGSFTPATEKNVFGYKEGVLEPNAEQNTKIPHLSNNDRIEVWIQKDGEKDYSLLISKTVGQIPGFRADKPKVNTTKLTENFTFQTFKVDWSYPKACNGVALSIPSPDILKEFLSFTLEVTDPTTNKTASYGPVLASEIRKNIVPEKNAAKQSCTFDFSLFKEFDMKKNYWGYMFTLKGKLDEAVPSGWEKKQPVSRPKDEKGKMKNGVTLVPTFEEPRTIELCKQIFPGKMFSLEQYMNAFKNKGTLSSPLTNQKSKVNGDHVTFNSVYPEFVIERQGELSNYPLLLAGIKKVTCIFKNTAKTEVITPTDTQFTMKNNALHVCFNTKIDVTQKEEPDGWKVAGEVGKGALLSALIPSSVENIKHEFNKYSTYNAEVDGLIKSDKYDKIFKVQLTVDKDILTDNNHKDQVFTIFETKI

SEQ ID NO: 29 - DNA, 1944 bp, Bacillus thuringiensis
atgaaacaaaataaaaataatatgcgaggagaattatgtatgaaatacaaagatcgaacacctgcaaaacgtaaatacaaacaagcattacttgctacagtagcaagtatgaccttaggagtaagtacattaggaagtatgccttctgcattcgctgatgaaaatacagcaaatatcccacaagcaacttctgcatcagcaactgatgaacccgttttcaaaagagaaagcaatggagctattacagttttaaaagacaaactattcaatatagaaaccttaaaagcagttggttcattaggtggagatacattaaagcaagcctgggctgattctaaagtagatggtgggaactttaacaacacttttagaactttagccatgggatcagcagcaataattccatatggtggagtagtcctttctccactaattgggctactatggtcagcggatacgacagatgaacagaatcggttaaacaaattgaagcaggagatttttgagcaaacgcatacacaaattacaaagcatgatttggaagaacttgaacaaaaactaaagaaactatatacagatttagaggaatttgaaaaaacaataaatcctaacggcagaaaacttgctgcagcaccttcagtaggtgataaagcagctgccattcgatcgcaagcggaatttattcataacgattttaaaaaccttatatcagaatctcaaaaaccgtcatataaagaagctgaacttcctatttttatgattgcagcaacggctcacttgaacttcttgcacttcatggaacttcacggtaaagatcctaaaataaactatagccatgacggactcgaacaaatgtttttaaaagatcaaaaacgagtccgtgaggaatacgtcaaatacgcaaacaacatcgctcagaaggatttagatcgtgcagatcggtttgccacaaaaggagtgccagagctgcttcatacgcgcgccaacgctgacactctcggagcccgtattatgacatatagtattaagaaagctatccaaggagagaacgaaaaccttgaaatagcattaaataagaccataaataatatagctttcaaacaagcagcaaacatcaaatctgagtggacactggatcaaaatggacgacctttctactacaggctagatggtaatatacaaactggatggaaagaaatttcaacttcatttgccactagatatgacttccttggtgaaaaatggttaaaagaacaaggactttcatattcaaagtattacttcagccctgaaaaaactgacaaattcgaaaaaggtgagatgtatagagacacgacacaaactattaatgggaaaacttatcagtttagtaaagatggtaagtgtctaaatccagatggagtacaaaaaactggttgggttcagcttggggatacatggtattatgtaagccctacagacagtactaaaaactcctcaggcgaagtatttaaacaggggaaagtagtaaccggaaaggttgaaattaaagggaaaacttattacttcaaacctgccacaggagaaatggcgactggatggaccaaaactggagataagtgttattacttcagtccagaagataacactaaaaactatgacggcaccacatttaacaaaggtgaaatgacgactggatggatgcagattacgagacttgaatcgagcaaaaaaattaccgattattattacttcagtcctacagacaacgctacaaacaactatcaaaaggggaaaacatttgctaaaggacaaatgtggactggatggatgcaatatactaaaaaagataatccagctaatggaaatgataagtggtactacttaaatgatagtactggagctatgcttcatgatactactactcccgacggctataaagtcgataagaaaggtgtacaaaag

SEQ ID NO: 30 - protein, 648 aa, Bacillus thuringiensis
MKQNKNNMRGELCMKYKDRTPAKRKYKQALLATVASMTLGVSTLGSMPSAFADENTANIPQATSASATDEPVFKRESNGAITVLKDKLFNIETLKAVGSLGGDTLKQAWADSKVDGGNFNNTFRTLAMGSAAIIPYGGVVLSPLIGLLWSADTTDEQNRLNKLKQEIFEQTHTQITKHDLEELEQKLKKLYTDLEEFEKTINPNGRKLAAAPSVGDKAAAIRSQAEFIHNDFKNLISESQKPSYKEAELPIFMIAATAHLNFLHFMELHGKDPKINYSHDGLEQMFLKDQKRVREEYVKYANNIAQKDLDRADRFATKGVPELLHTRANADTLGARIMTYSIKKAIQGENENLEIALNKTINNIAFKQAANIKSEWTLDQNGRPFYYRLDGNIQTGWKEISTSFATRYDFLGEKWLKEQGLSYSKYYFSPEKTDKFEKGEMYRDTTQTINGKTYQFSKDGKCLNPDGVQKTGWVQLGDTWYYVSPTDSTKNSSGEVFKQGKVVTGKVEIKGKTYYFKPATGEMATGWTKTGDKCYYFSPEDNTKNYDGTTFNKGEMTTGWMQITRLESSKKITDYYYFSPTDNATNNYQKGKTFAKGQMWTGWMQYTKKDNPANGNDKWYYLNDSTGAMLHDTTTPDGYKVDKKGVQK

SEQ ID NO: 31 - DNA, 1809 bp, Bacillus thuringiensis
atgaataagaaattgtacaagaaattcttattatcaatgatgattgctggaatggtaacaagtaatatagtaccacttcatactttcgcggcagaacaaaaagtccatacaactatatcgcaagaaaccattcataattattcacttggtcctgagggctttcaagatgtactagcaccagcaatgtctaatgtacttgttatggattcatatgccaaaacaatacgtaatcaacaagagacagaccttagtggtataagttctcttaatagttatttacgagcaaacatgttgaagcaccaggacgatgcaaaaaaaaacgcgacctattggttagataatcttaaaccacgtattatgaatacgaatcaaaacattgtaaattataatgaaacatttcaaacgcactatagtattttactagctgcaatagatcaaaaagatactgaaaaattgaaaactgagctcgaaaaattgtatcaaagtatattgactaataaaagtgaagttaacgagctattggaacagctgaaaacattccgaaataaaatgaaagcagatacgcaaaactttaaacaagatacaaatcaattaacgactattttagctagtacaactgcaggtattccatatttagaacagcgaattaatgggtataatgagtctatcaaaaaaagcaatgatcaaattattgcaggttcagtactttgcgcgacgttaataacgtgtatcattggtggaccgctgattgcaacagcaaaaagtaatattgcatctgctgagcgagaaatagaaattttaaaagcacaaatttctggggcacaagcagaaatagctattataactgatgcaaaaaataagactacgaatatggcggaaacaattgacacagctattacttctatacagaaaatgtctaatagttgggatactgtagcagcaaaatataataatttagtaaaaaatatcacatttattaccccagaagaatttgcttttataaaagcagatcttaatacagcaaaagatagctggcaagatcttaagaattatgctgataaattatatgaatcggtgaaaattgcggagaaagaagagcaggatcttatggatcgacttcgtccgtcaagtgttcaatatttctacaaaccgatacataatgcctatacatttgaaataaaaacgggagcaaatgcaccaaatgcgtcctataaagttatgaatttaacaaaacggactactcataatatgtggagcggaggaccaaatgcaagcatgtggattgaccggcttccattaaacttcaaagaccaatatgcggtaatagcaacggtcaatggaatggattatgtcatatataaagaagtaggagaaaacattcctggagctaatttgaatggtacctatcaactattttctgcgttaaataatagtagcgttatagatatggatcgatcaacgaataatgttaccttatggagcaataacggcggtaatcatcaaaaatggaagttagtatatgattcaaataaaaaggcctatcaaattaaaagtgtaacaaatgaaaatttaatattagcttggaatgactatcaaggttctaacaatgtttttgctacacctaaccaatactatgaagagcattattggatagttgaagatgcaggaaatggatatttttatttaaaaaataagaaaaactctaggtatttagatgtaactggttctggtactaaaaatggaacaaatattatagtatatccatttacagctagtaataatcaaaaattcaaattacagagactaaat

SEQ ID NO: 32 - protein, 603 aa, Bacillus thuringiensis
MNKKLYKKFLLSMMIAGMVTSNIVPLHTFAAEQKVHTTISQETIHNYSLGPEGFQDVLAPAMSNVLVMDSYAKTIRNQQETDLSGISSLNSYLRANMLKHQDDAKKNATYWLDNLKPRIMNTNQNIVNYNETFQTHYSILLAAIDQKDTEKLKTELEKLYQSILTNKSEVNELLEQLKTFRNKMKADTQNFKQDTNQLTTILASTTAGIPYLEQRINGYNESIKKSNDQIIAGSVLCATLITCIIGGPLIATAKSNIASAEREIEILKAQISGAQAEIAIITDAKNKTTNMAETIDTAITSIQKMSNSWDTVAAKYNNLVKNITFITPEEFAFIKADLNTAKDSWQDLKNYADKLYESVKIAEKEEQDLMDRLRPSSVQYFYKPIHNAYTFEIKTGANAPNASYKVMNLTKRTTHNMWSGGPNASMWIDRLPLNFKDQYAVIATVNGMDYVIYKEVGENIPGANLNGTYQLFSALNNSSVIDMDRSTNNVTLWSNNGGNHQKWKLVYDSNKKAYQIKSVTNENLILAWNDYQGSNNVFATPNQYYEEHYWIVEDAGNGYFYLKNKKNSRYLDVTGSGTKNGTNIIVYPFTASNNQKFKLQRLN

SEQ ID NO: 33 - DNA, 2403 bp, Bacillus thuringiensis
atgaaaaagaaacaaaaaacactctctatgacagtagctacaggtgtacttgctggtacatacattccaactgcatacaaggtatttgcagaaactgaacaaaaagaagatttcaaagaaaatcaaacaaaaaatagtgatcaaaataatcttctatttgattcacgtggtttgtttgaaaacccttacaaaggggtaactgttgagagttttttaaatgcatttaatagtaatcagttcaaaccgctattaacccatatacatcaaaataaagatgctggctcaggtactattgcttttctaaaaggaatgatgaccacaggattatctttattaccaccaccagctagtctattaggaagtatttggtatgtatttatgcctggctctagcgttcaagatgatatgtggatgcaattagtaaaatacattgatgaacaaatagatagcaatataaatgattatcataaatatcttatgagtgcagaatgtaaaggttctatgacagcgataaaagaatatcagcgagtgctgcaaatatataatgacagtaaaaatagtttgacaagagtcgaagagcctggaacaccggtaatcgaggctgttcgggcagcggatagggatttgaaaaagtttattactattattcagacccctgaaaaaagcagtgattctgtgtatcaacaattaacagctccaatctttgtacaagctgtaaatgtccatctcctattactgagagacatgattctatatggagaagaggcgggaatggataaaaatcaatggcaaggatatagggatcaactgaaagaacttattcaagaatatacgaattacgctatgaaagtatataacgatggattgaaaaaaagaaaaaatgaagctgaacagattaatacccaagaaaaatataggaatactgacagttggaatcatattaatgaatatgtaagggaatatacattaagcgttctagactttgtagcattgtttccatctaccgatcctagtaatattctaaaggaacaatgcaaaaaaaattctaggcaaatttattcagatattggaaggaaagtccaaccaaatgaaaaaacatggcaatatatacaacagatcttagactcccaagaatataaaggtgaactgaaacagcttgatatacgatgttggggtcgtattgatgccattcaaccatggtatgataatcgtgtggttggtggaatattgtatcatactcctggatgggttggaaatacgaatggaggaactttaagagagcgcattcattccgcttctaatcctataactaaaattacgatgggatcagaaattactcctaattatctcgacattacccatgatgacagaaagacataccctcgatttggttcaacccactctgggattggaaaggaatctacttttgaatttcctaatcaaaaggtttctcttgttcacgcatttaacagaaacactcaacctgggtttgaaggtattgatgcagtagtatttggatttagcgacaaaaaagttgatcttagacacgctttgatgacaaatatgataaattcaatcccagctgagatgtataataggggaattagtaatttcaaaccacaaattgaacctacacatgcggcgcaaaaggcaatgaaaacagatactactaattcttatttagaatatagcgtagaaaattttaaagagcaagaatataaaattagatatagggttgcagctaacgagaatgctaaaattagtctttcacacagaagtagtgccagtaataatttcacaaaaataggtgacacattaatccctactacaggacatgcaggagacactgtaaaaggtgaatgtggtcattacaagattgtagaaggacccactgtcaaattaaaatggggaacaaatgaattgaaactggaaaatgcacaagggaaattttctttagctgaaattgaattagaatctgtcgaaaaggatgaagttatagccgaggataattttgataatcaacgattaaattgggtaaacataggtggtattgtagatgaaggtatgataggaaaagctggtatggttggtacaaatggagatacttggacgtatattcaagatcgagtagcaacaaattctaggtataccttgagcatgaaagtaaaattaaattccgatgatgaaaatgcaaggaaaaaggtaacgatattcacagataatgcaaatcatgagcgaattacaaaaacagtcgagcttaagggaggggcaggctatcaagaaataaagctagaatttatttcaaaaagaggttctagtaacactcatgttggcatccaaacattaaatggaacatctagtgtattatttgatgatgttaaagttatcggtgcaaaaaatggt

SEQ ID NO: 34 - protein, 801 aa, Bacillus thuringiensis
MKKKQKTLSMTVATGVLAGTYIPTAYKVFAETEQKEDFKENQTKNSDQNNLLFDSRGLFENPYKGVTVESFLNAFNSNQFKPLLTHIHQNKDAGSGTIAFLKGMMTTGLSLLPPPASLLGSIWYVFMPGSSVQDDMWMQLVKYIDEQIDSNINDYHKYLMSAECKGSMTAIKEYQRVLQIYNDSKNSLTRVEEPGTPVIEAVRAADRDLKKFITIIQTPEKSSDSVYQQLTAPIFVQAVNVHLLLLRDMILYGEEAGMDKNQWQGYRDQLKELIQEYTNYAMKVYNDGLKKRKNEAEQINTQEKYRNTDSWNHINEYVREYTLSVLDFVALFPSTDPSNILKEQCKKNSRQIYSDIGRKVQPNEKTWQYIQQILDSQEYKGELKQLDIRCWGRIDAIQPWYDNRVVGGILYHTPGWVGNTNGGTLRERIHSASNPITKITMGSEITPNYLDITHDDRKTYPRFGSTHSGIGKESTFEFPNQKVSLVHAFNRNTQPGFEGIDAVVFGFSDKKVDLRHALMTNMINSIPAEMYNRGISNFKPQIEPTHAAQKAMKTDTTNSYLEYSVENFKEQEYKIRYRVAANENAKISLSHRSSASNNFTKIGDTLIPTTGHAGDTVKGECGHYKIVEGPTVKLKWGTNELKLENAQGKFSLAEIELESVEKDEVIAEDNFDNQRLNWVNIGGIVDEGMIGKAGMVGTNGDTWTYIQDRVATNSRYTLSMKVKLNSDDENARKKVTIFTDNANHERITKTVELKGGAGYQEIKLEFISKRGSSNTHVGIQTLNGTSSVLFDDVKVIGAKNG

SEQ ID NO: 35 - DNA, 3561 bp, Bacillus thuringiensis
atgaatcaaaataataatgaatatgagattatagatgcaaatccgtcaacttattccaattgtccatccaacaaaaataactttagatatccttacgcaaataatccaaaccaagcattacaacataccaattacaaagattggattaatatgtatcaagaaaatcagcaatatcgtgagaatcttgaggtttttaatattgatatacctgcagcagttggtgcaggtattattgtaataggtactataatgactgcttttgccactttagtaccaggtggaattgtactgatatctttcgggacattattacctatcttttggccatcaacaacagagtttaaaacggtttgggagcagtttatgacacatggtgaaacaattatcggacaaaatttacaacccgataaacgaaatgacgtcatgctaaaattagaaggccttagaaacgttttaaaaacctatgaagaacaccttcaaacatggaaaaacaatccaactccaaaaaacgccaacgatgtactaaatcaaatcgctatagttcattctcattttgaatcagatatgcctacaattcaagggaaaccgatagttccaggtagttctgattatagagtaatactattatctgcctatgcacacgctgcaaatttacatctaaatttgttaaaccaagcagcccgatttcaagatcgtttgaacgctacccaacaattctcttattcaggcaatctatcaagagctattgattatcgtggaaaattagaagaatatatagaaaaatatattaatgaatgtacagaaacctataaattaggcttaaataaacttaaaaattcccctgaaatctcatgggatatttataatacgtatcgtagagaaatgacgcttactgtattagatcttgttgcgctttttccagattataatgtacttaactatccagtaggaactaaatcagaacttactagaaaaatctattcaaatacttttggaccacgtctttatagcggaaaagaagatcttactatacaagaagatttattcacacatcaacctgatttgtttacaatactaagatcatttacctttaatgaaagcgaagaaatagaatattattatctatccggtattataaataggcataattacattaattcttctgctattatagaaagaccatttggagattcaagtaagcctgtacaaaatctaaaaattattcctaaaaaaataattcgagttcatttcgcaagagctgcaattataattagtgcgggtacggctgtttttcaaatcacaattttaaatttattttatggggaaggaccacaggattattactcatatatatctggtaaaccagcacctgagctacaatccacagatcttaagtttcctgatcacaatttacattctatttcaatatttccaaggaacactgaacttggtaatacgtttgaagtatatttattcacttggacacattctggtgtttctactaacaatcaaatatatgaagatgtaatcacccaaataccagctgtgaaaggtaatgttatccaagctggaacaaaccctaaccccaacttggattcacaagttattcgcggtcctggtttcacaggaggagatttagtccgtcttagatccaaaatgatccttacgatccaatcacctagatcacaaaatacaacttcaaccttttattatatccgtattcattacgcgtcaaatagcactactttaattactataaacattccagctttaagaattaatcaaaacatgcatttacctgcaacctttactcatgtcactgttcctgatttaaaatatacagaatttaaatatttacaatttaacgccccagtggaaatccctccaaatgaaacaatagatatagaactttttggaaccagtggttcagagttgttactgattaataaaattgaatttattccagtaaccccgtctgtcaaacaaatgcacgaagaacaaagatttcaaaaaacaaaacaaagtataagctcattatttactactgacagaaataacattttgaaattagaaagtacagattatcaaattgatcaaattgcaaatttgacagaatctatatcagaggaattatacccaaaagaaaaaatgatcctattagataaagtaaaatatgcaaaacatttaagtcaatcacgaaatttactcgataatggaaattttgaatctacaatgggatggacaacaagtcataacattactattcaaacagataatccaattttcaaagaacaatatcttcatatgccaggagcaagaacaacagaaattggcaatacaatctttccaacttatgtttatcaaaaaattgatgaatcaaaattaaaaccatatactcgttatatcgtcagaggatttattggaagtagtaaaggtttagaaatacttgtcagaagatataacaaaaaagtccatacaatcatgaatgtacccaatgatctaaccaacataatgtcttatgaagaatccaattcatgtaacccatgtgaaccgcaatcgtattctgttatgagtgaaaaagactataaaatgagccaaatatcacaaaatccgacaatattacagtacacatcagatttcaatcaacatacatgtgactgtgaaacaaacacagtaaattcagcctatcatgcctctcatgtattttcaaattctattgatacaggaaatttagatttcaatcaaaatcttggtattggaatcctatttagaatctctaatccagatggatatgcaacattaagtaatctagaagtaattgaggaaaaaacattagtgggagaagaaatcaatcaagttaaagaaaaagaaaacagatggaaaaacgatttagattataaacgaaatgaaacagaacaggcgttttcacgagcgcaacaggcagtaaatcgtttatttataaatacccaacattctatgttgaaaatagaaacaactatgcaagatattctgatagccgataatcttatcgattctatcccatatgtgtacaacaaatggttaccaaatgaaccaggtatgaattataatatgtttacagatttaaaaaatcagatttcacaagcatattctttatatgaaaatagaaatatgattcaaaatggtaatttcataaatggtttaacaaattggtatgcatcatcagatgcagaaatacaacaaatagatggtatatccgtacttgttctcccgaattggagtacacaagtatctcaacaaaatatacagttacaaccaaatcataaatatatgttacgtgtcacagcaaaaaaagaaggaatgggaaatggatatgtaaaagtgagtgattgtgcaaatcatgtagaaacactaacttttaaatccagtgatatcaataacaacaatatgtggaatgaatctataggatatatgaccaaaacaatgtatgtcactccacatactagtcaagtacgcattgatataggagaaacagaaggtacttttaaaatcaatagtgtggaattgatttgtatgaagaat

SEQ ID NO: 36 - protein, 1187 aa, Bacillus thuringiensis
MNQNNNEYEIIDANPSTYSNCPSNKNNFRYPYANNPNQALQHTNYKDWINMYQENQQYRENLEVFNIDIPAAVGAGIIVIGTIMTAFATLVPGGIVLISFGTLLPIFWPSTTEFKTVWEQFMTHGETIIGQNLQPDKRNDVMLKLEGLRNVLKTYEEHLQTWKNNPTPKNANDVLNQIAIVHSHFESDMPTIQGKPIVPGSSDYRVILLSAYAHAANLHLNLLNQAARFQDRLNATQQFSYSGNLSRAIDYRGKLEEYIEKYINECTETYKLGLNKLKNSPEISWDIYNTYRREMTLTVLDLVALFPDYNVLNYPVGTKSELTRKIYSNTFGPRLYSGKEDLTIQEDLFTHQPDLFTILRSFTFNESEEIEYYYLSGIINRHNYINSSAIIERPFGDSSKPVQNLKIIPKKIIRVHFARAAIIISAGTAVFQITILNLFYGEGPQDYYSYISGKPAPELQSTDLKFPDHNLHSISIFPRNTELGNTFEVYLFTWTHSGVSTNNQIYEDVITQIPAVKGNVIQAGTNPNPNLDSQVIRGPGFTGGDLVRLRSKMILTIQSPRSQNTTSTFYYIRIHYASNSTTLITINIPALRINQNMHLPATFTHVTVPDLKYTEFKYLQFNAPVEIPPNETIDIELFGTSGSELLLINKIEFIPVTPSVKQMHEEQRFQKTKQSISSLFTTDRNNILKLESTDYQIDQIANLTESISEELYPKEKMILLDKVKYAKHLSQSRNLLDNGNFESTMGWTTSHNITIQTDNPIFKEQYLHMPGARTTEIGNTIFPTYVYQKIDESKLKPYTRYIVRGFIGSSKGLEILVRRYNKKVHTIMNVPNDLTNIMSYEESNSCNPCEPQSYSVMSEKDYKMSQISQNPTILQYTSDFNQHTCDCETNTVNSAYHASHVFSNSIDTGNLDFNQNLGIGILFRISNPDGYATLSNLEVIEEKTLVGEEINQVKEKENRWKNDLDYKRNETEQAFSRAQQAVNRLFINTQHSMLKIETTMQDILIADNLIDSIPYVYNKWLPNEPGMNYNMFTDLKNQISQAYSLYENRNMIQNGNFINGLTNWYASSDAEIQQIDGISVLVLPNWSTQVSQQNIQLQPNHKYMLRVTAKKEGMGNGYVKVSDCANHVETLTFKSSDINNNNMWNESIGYMTKTMYVTPHTSQVRIDIGETEGTFKINSVELICMKN

SEQ ID NO: 37 - DNA, 1968 bp, Bacillus thuringiensis
atggaaaacatgaagaaacaattagcgaatgttataactggtacactattagctcctatgtttttaaacggagatataaattctgtttacacggattgtcaaacaaaacatgggcttacagctcaggagaatcaagagaaagaagtagatcgaaaaggactttttggatattactttaaaggtaaagattttaataatcttactgtatttgcaccaacgcgtgataatgtccttgtttatgatcaactgacagcaaatacattactaaatcaaaaacaaaaaagctatcagtctattcgatggattggtttaattcaaagcaaagaaacaggtgatttcacatttaacttatcaaatgatgaacatgcggtgatagaaattgatggaaaagtcgtctctaataaaggtaaagaaaaacaagttatccatttagaaaaaggacagtttgttcctatcaaaatagaatatcaagctgagaaaccatttaatacggaatgtcaaacctttaaaaaccttaaactttttaaagtagataatcagcaacagcctcatcaaatccaactagatgaattaagaaagcctgaatttaacaaaaaagaagcacaagaatttctaacaaagacaacaataacaaatctagttacacaaaaagtaaagagtaacagagatgaagagacggacaaagtggaagactctatcccagacagttgcaaagaaaatgggtataccatccaaaataaaattgccatcaaatgggatgattcactaacaagtaaaggatataagagaatcatttcaaatccacacgatactcacatgattgtagggccttattgtaattatgaaaaagcagtaagagatatagatttatcaaatgcaaaagaaaaatttaacccattggttaccacttttccaagtgtagttagtatagaaaaatttatattattatcaaatgaggatttaacaaatagcgtagagcttcattcatcctcaaattgctcgtatataaataaagaaggggattcagttgaaacagaaatcggaaaagaaggctttttctttggagtaagtgtaaactatcaacaatctgaaacagttgggtatgaatggggaacgtctacatggaatatttttcaatttaatactgcatcagcaggctatttgattcgaatgttcgagacaataacggtggagcaagaacccatctattatgtaaagcctacatcgagtttcgtattaaataaaaataccatcaaagtgataacagtaaaatcgaatttgactacattaagtatatctccgggacagatttataaaaaacaaggtcaaaatggaatcgtaataacatcgatggacgattttaacgctcagtcgattacagtaattaagcagcagttaggtgtattaaataataaacctgttatattagagacaggcgttattgtgaaatgggtacatgaaatgaatgatgtgacacaacgaatcgaagttaaaactgattctattatcgccaataatggaaaacgtgtggctgcaaaattttatacagacctagaagataaaaaaacagaattgatgttaataaatatactaaaactttcatcttcaaatattacaattgtattattcgaatgtaaaaataaaaaagtatatgaatcgattgttataatttatctagatgaaaatgcggaaagagaagtcaaaaaacatataaatgacacaatagggggttttaagaatgtaaaccatttatataatgtaaaattgacagtaaagatgaattttacgttcaaaatggccactttgtatgacgtggaagatggagcaaatgctgggtatttagtgagatggaataatgtgagtattggggacgaaattcgtactggtgaattagtggcggtttcataccatagctacagctatcttcaaaggcgaaaagtaaagatgctatccttcacttggatcaag

SEQ ID NO: 38 - protein, 656 aa, Bacillus thuringiensis
MENMKKQLANVITGTLLAPMFLNGDINSVYTDCQTKHGLTAQENQEKEVDRKGLFGYYFKGKDFNNLTVFAPTRDNVLVYDQLTANTLLNQKQKSYQSIRWIGLIQSKETGDFTFNLSNDEHAVIEIDGKVVSNKGKEKQVIHLEKGQFVPIKIEYQAEKPFNTECQTFKNLKLFKVDNQQQPHQIQLDELRKPEFNKKEAQEFLTKTTITNLVTQKVKSNRDEETDKVEDSIPDSCKENGYTIQNKIAIKWDDSLTSKGYKRIISNPHDTHMIVGPYCNYEKAVRDIDLSNAKEKFNPLVTTFPSVVSIEKFILLSNEDLTNSVELHSSSNCSYINKEGDSVETEIGKEGFFFGVSVNYQQSETVGYEWGTSTWNIFQFNTASAGYLIRMFETITVEQEPIYYVKPTSSFVLNKNTIKVITVKSNLTTLSISPGQIYKKQGQNGIVITSMDDFNAQSITVIKQQLGVLNNKPVILETGVIVKWVHEMNDVTQRIEVKTDSIIANNGKRVAAKFYTDLEDKKTELMLINILKLSSSNITIVLFECKNKKVYESIVIIYLDENAEREVKKHINDTIGGFKNVNHLYNVKLTVKMNFTFKMATLYDVEDGANAGYLVRWNNVSIGDEIRTGELVAVSYHSYSYLQRRKVKMLSFTWIK

SEQ ID NO: 39 - DNA, 1641 bp, Bacillus thuringiensis
atggaacacacagacaaaaatagaaacgagccacagcaagccacacctaatccacaaggtgctagcggtataagaagtaatgcctcaatatccgctgatgagaaagacaagaatgctattcagcaaaaaagtcctaacacctattatgagggtacacaagaaaatctgggtcctctagcacaatttgatacatgggtacaagatcttgggaaaaggaattataaacacacagttgctatggcagaaaagctactaccaacaatctataaagatttaaatagaggaaatttcaacaatactgcaaggtgcattactatgttatctacagcgttaattccatatggagtggcattcatttctccaataattgggattctttggccggagaacgggccaaatataaaagaaatgctgcaggaaatggaaaataaacttgttagaataatggatgaaaaaattgaagccaaagatttagatgatcttgaggctgcagtaaaaggattgatggtaactctaaaagaatttgaaaactcattgcagggtaatataggtggtgaaaattattctgccccagctgatgtagactcacttaaccgaggtcgtataacagccattcaaaaggggtttaacgatcttattagtgcagctagtaaaccgaggtttaaaataacagaacttcctatatatacaattattgcaactgctcacttgaatttcttgcatactgtggaaaaacagggaacttcacctaaaataaactacacagaagcagccttaaaagattttctacaaaatatgaagaagaatcacaaggattatgcaaattatatagaaaaaacgtttaaagaaggagaaactagaatcgatagtaaactagaagacaagcaacaaatagaaaaagaattagataaagtacacgaacagttatcagcacttggtcccaaacctaagaatcacactcacatagaagaaaatagatatataaataagaaggaggaactttacgaacgagcaaggtctcttaaggaaaggttgtctaaatataatgaattaatgtatcaaaagagtgatttttatagcaagacaaagggtagcacagcattccaaatagcatcaacaggaaaaacaacagcaaatccaagttgggttaatacagaaggatcgtgggttcacaatgggttttggtattatattgatgcaaaagggcaagtgaaaaccggttggttcaataataaggcacctgatggtaaggatagatggtattaccttagcactggaacaactggtctcgacagtgtaagggggaattctcttcttcccaaaggaacaatgctaactggttggttccacgatacgcgtaaagataagcagatgatcggtgtgaatacgaagactactaatgaatactggtattacctcagcccggaaaaaaatcttaaaaattctgccggagaactatttaatctaggacagatgatgacaaaatgggttgaaattaaggatacaaagactggtgaaccacaatggtattattttaaccctgaagacggtagtatgatacatgataaaaaagcggtacaaattggtaacctaaaatatgattttgattccaatggtgtgtgtacaacgcctaacggttac

SEQ ID NO: 40 - protein, 547 aa, Bacillus thuringiensis
MEHTDKNRNEPQQATPNPQGASGIRSNASISADEKDKNAIQQKSPNTYYEGTQENLGPLAQFDTWVQDLGKRNYKHTVAMAEKLLPTIYKDLNRGNFNNTARCITMLSTALIPYGVAFISPIIGILWPENGPNIKEMLQEMENKLVRIMDEKIEAKDLDDLEAAVKGLMVTLKEFENSLQGNIGGENYSAPADVDSLNRGRITAIQKGFNDLISAASKPRFKITELPIYTIIATAHLNFLHTVEKQGTSPKINYTEAALKDFLQNMKKNHKDYANYIEKTFKEGETRIDSKLEDKQQIEKELDKVHEQLSALGPKPKNHTHIEENRYINKKEELYERARSLKERLSKYNELMYQKSDFYSKTKGSTAFQIASTGKTTANPSWVNTEGSWVHNGFWYYIDAKGQVKTGWFNNKAPDGKDRWYYLSTGTTGLDSVRGNSLLPKGTMLTGWFHDTRKDKQMIGVNTKTTNEYWYYLSPEKNLKNSAGELFNLGQMMTKWVEIKDTKTGEPQWYYFNPEDGSMIHDKKAVQIGNLKYDFDSNGVCTTPNGY

SEQ ID NO: 41 - DNA, 1371 bp, Bacillus thuringiensis
atgaattctggtcaaagaaataatgagtggaacaatcaaaatatgtttgatgaacacatgaatcaaacgattaataaagataaatcgtgccattgtaactcagttataaatggcacgctatttacagaaaataacaatccacctcaaccaaatttacctgatgaaagtaaaagatttcaaacgattactttttcttattcttctcacaatcgtggtttagatgctttaagaactcgacctggagatcttttaggtaatgatttgggagaattttgtcgtaatgtaacacttcaaaatcaagtagtaaatgattgggtccatgggaatggaaatcgacaacgatttatattttaccatacagatagtggaagatttgtaatagcaaatcaagcatatggggaagttttaacgattgtgcctaataataatcattcaacagttactcgattgtataatggtgaatctagtcagttattcagaaaagtttcagatacgagtggtaattttaatctagtaagtgataataacaattatactatatcagcatgtggtacagccgatcaggtggattcgtggaatagaattacagtgggtcttcctactgttccgagcaatcactcaagttttttacttagacatatagagtctcaaaatagacctgtaacttttcatccactatcacctccaacacaattagttgccccgccaccattaacatcactgactgatactggtcttaacccaaatatagcaccaagagcaattttaggaaacacattaataccttgtatattaataaatgatataattccactagatcaaagaatcagagatcatccatattatattttaacacgtaatgtatattggtatagattatggacagatacaatccctgcaggatcgactgttaataaaattgaaataaccggaatgcattcagatgtacaagaaaacatgaaaaatacattagatatgtcaataggagcagattggggtttgcaattttttcaaaagacaaatccgtttaaacaacaaattagtagtgggttaaatacaaatccttctcacactattacacctttaggattacgggaagacgaagtaccgtatacaaatcgtacgtttgagagtgtgagatatataaggtatgtaaaagcatatgaatatgtattaacacgttctgataaaacaaccgtaggaactccatggacttactacgattataatagtatgttgttacaaacatatcctacgaatcaattcataataatggaaaatgataaaatagtaagatgtgataatagttatgatttatctgtatggaaaaccccaatgaaaatacgagatggtgaaattatcgaaagaaaa

SEQ ID NO: 42 - protein, 457 aa, Bacillus thuringiensis
MNSGQRNNEWNNQNMFDEHMNQTINKDKSCHCNSVINGTLFTENNNPPQPNLPDESKRFQTITFSYSSHNRGLDALRTRPGDLLGNDLGEFCRNVTLQNQVVNDWVHGNGNRQRFIFYHTDSGRFVIANQAYGEVLTIVPNNNHSTVTRLYNGESSQLFRKVSDTSGNFNLVSDNNNYTISACGTADQVDSWNRITVGLPTVPSNHSSFLLRHIESQNRPVTFHPLSPPTQLVAPPPLTSLTDTGLNPNIAPRAILGNTLIPCILINDIIPLDQRIRDHPYYILTRNVYWYRLWTDTIPAGSTVNKIEITGMHSDVQENMKNTLDMSIGADWGLQFFQKTNPFKQQISSGLNTNPSHTITPLGLREDEVPYTNRTFESVRYIRYVKAYEYVLTRSDKTTVGTPWTYYDYNSMLLQTYPTNQFIIMENDKIVRCDNSYDLSVWKTPMKIRDGEIIERK

SEQ ID NO: 43 - DNA, 870 bp, Bacillus thuringiensis
atgcaaaagaaaataatattgtgtggtgtgatggctagtactttattaggtacgggtattttttctaatactgcaagtgctactgaaattcagaaaaatagagaagatattgtagattataagaatgttggtcaacaaggggcaatagaagatattgatagaaaaattgatagtatgatagatgccattcctccgtatattgaaactaagtggcggaggctaggggatggaacagttaaaatatccggagtaaatattgaaaaaagtaatgttacaaataccatacctttatttttaggatcaaatacatttataaatgatacagatcgagaaatgacatataatactagtacttttagtgaagaaattacaacaaccacatctactcaaatcgaaaatggctttaaaactggacttgctgcagaaggaaaagttggaattccatttgtagctgaaggcaaaatcacaactactcttgaatataattttgctaatacaaatacaaatacagatagtattactaagacaattacagctccttcacagcctgttccggttaagccacattcaataaccaaagcggaagtttatttcgaaaagaaatctacttctggaaatgtagaaatatttgcagatgttgcccaactgataatagcaggtcgcactataacaaatataggtaatggactagatatgacaactaacacatatggtttaattaaaactcctgataatccacatacagttcgtgtaaagggaagtgggaaatttactactgaatatgctacagacttaattgtaaaaacgtatgacgtaacatcaggtgaaaaatctgctaaattgatagattctaaaagaatttccataaat

SEQ ID NO: 44 - protein, 290 aa, Bacillus thuringiensis
MQKKIILCGVMASTLLGTGIFSNTASATEIQKNREDIVDYKNVGQQGAIEDIDRKIDSMIDAIPPYIETKWRRLGDGTVKISGVNIEKSNVTNTIPLFLGSNTFINDTDREMTYNTSTFSEEITTTTSTQIENGFKTGLAAEGKVGIPFVAEGKITTTLEYNFANTNTNTDSITKTITAPSQPVPVKPHSITKAEVYFEKKSTSGNVEIFADVAQLIIAGRTITNIGNGLDMTTNTYGLIKTPDNPHTVRVKGSGKFTTEYATDLIVKTYDVTSGEKSAKLIDSKRISIN

SEQ ID NO: 45 - DNA, 672 bp, Bacillus thuringiensis
atggcggcaacaaatttattgattgggcgaattaaaaacatatatctcttttttcaacataaaaatataaagaagttcatttacatcaaactctaccctgatgaaggaggcaaaacaaaaatggaaaatgtttatcaaaaccacagcaaacatgagccacaacaaaatccttccccaacacagcattctcacttttcaaatccaatacatgatcatgaaaaaaatcatgtattacctttttctattttggtcaatattccaaaaggatttcatatacaaaaacaaacagaccccaaattggtatacgacttaagctacctttctatgacgaaagaaatttgtaaaaaatccattgaagttgatcattgtggttgcgtagatgtggatttacatgtattaaaaataaaaggttgtttatcctttttactcaatttatgtatagaaccgattcacaaacaaaaaatctgctccacagatgctaaagatgactccattttcttgtgttgtcaagatacattatatgtagatcacatattaaaatatagtgtcggaaaattaccttattatgtgattgatgaggatcatattcaagtacgaaaattagaaatacaagtgttagatgattctcctcaagtcgcaaaaatttcaggtgtcttttattttgaatatgaa

SEQ ID NO: 46 - protein, 224 aa, Bacillus thuringiensis
MAATNLLIGRIKNIYLFFQHKNIKKFIYIKLYPDEGGKTKMENVYQNHSKHEPQQNPSPTQHSHFSNPIHDHEKNHVLPFSILVNIPKGFHIQKQTDPKLVYDLSYLSMTKEICKKSIEVDHCGCVDVDLHVLKIKGCLSFLLNLCIEPIHKQKICSTDAKDDSIFLCCQDTLYVDHILKYSVGKLPYYVIDEDHIQVRKLEIQVLDDSPQVAKISGVFYFEYE

SEQ ID NO: 47 - DNA, 1131 bp, Bacillus thuringiensis
atggttacagcaatattagcaagtccttccaactatgtaagtgtttacgcggagaaggtgcagtctaaatcagagtcaacatatgtacaaaatgtcaaaaatgcgaatacattatcacattcgattagaacgttaggttcacaatcacctttagcacaagcatatggattaattattttacagcaaccaaccattaaagggactggtatgagcagtttaacgaatcaccaagaatttgtaaaaaatcatgttcgcgaatggttagatgaatataatcctaagttagttgacttaaatcaagatatgcagcgttttagtacaagattcaatggttattatggtacattatatgatttagcgggaacggtaaatacagatgcggaaacaaaagtgagttttgcaaatgcttttaatagactacaacaggacgtacaaactatccaagatagtatgaaccaaaccttattgcagctaaatcgttttaatgatttattgcttcaagataacaaagggttttctgaaaaagcaaaagtagcaattcaatccttagaggggtcagatggaactgttacacagctaagggctgatattaaaagacttcaagaagagatactggtagaactcgcaaaaattttaaatagaccaaatgaagttcgtaacggcgttataaatattgggaagcaagtctttacgattgcgggcggagcagctcagactcaaactatagattttatctctatttcatctcttggtggtggaattttagatcttttcgacagccaaacagctgcttctgctaggctcattgagcagaaacaaaaagaattactaccactaattcagcagttagcagaaacccaaattcaagtgactgaaatgacttttattgaggatcaaatgaatgggtttactgagatgattaagaggcaaattactacttttgagtatttgatgaatgattggaaagcgttaaatgatacaatgatccaaatccaactcgatctaagtgcaggggcacatatggatagtgttggattgcaaaatcaattaattcagctcaaagaattcagtgatgaactgtatttgcaaacaaaaaagtttgaaaatttcatttcaaatgtaacaataaat

SEQ ID NO: 48 - protein, 377 aa, Bacillus thuringiensis
MVTAILASPSNYVSVYAEKVQSKSESTYVQNVKNANTLSHSIRTLGSQSPLAQAYGLIILQQPTIKGTGMSSLTNHQEFVKNHVREWLDEYNPKLVDLNQDMQRFSTRFNGYYGTLYDLAGTVNTDAETKVSFANAFNRLQQDVQTIQDSMNQTLLQLNRFNDLLLQDNKGFSEKAKVAIQSLEGSDGTVTQLRADIKRLQEEILVELAKILNRPNEVRNGVINIGKQVFTIAGGAAQTQTIDFISISSLGGGILDLFDSQTAASARLIEQKQKELLPLIQQLAETQIQVTEMTFIEDQMNGFTEMIKRQITTFEYLMNDWKALNDTMIQIQLDLSAGAHMDSVGLQNQLIQLKEFSDELYLQTKKFENFISNVTIN

SEQ ID NO: 49 - DNA, 1545 bp, Bacillus thuringiensis
atgaaattaatatcaaaaatagtaatgaccgcgttaatagtattgagtacatttacattcaacttaggtggacaatttgataaaagttttctttctgcctcaaaagcatatgcggatgtaatcaaggcacttccacaaaatgcttcaaagatagagttagattatgctcctgtgtatgactacgacacagatgggtgttatgcgactgcagcaatttctccagatggtacgactaaccctggtctaagtttgggcggttccccggaaagtgtctgtagagatgttaaccgactggaaaattcaaacacttattctcgggccaaatcaaataatggttggactgccattatgtatgcgagttactttgagaaagatcaacaaacttcgggccctgttgcgcttggacatcgacatgactgggaacacacaatagtttgggttaaagatagtcaggttcaatatgtaacttattcagcacatggtaattggtacactaatcctcgctcaaacgttagattcgatggaaaccacccgaaaattgtataccataaggacggcggcttgacacatgcttttcgcctggctaatagcaatgacgagccgccagaaaactattatcaccagtggctccaactaccaatggttggttggaatggctatccaagcccaaatattcgtgaaaaactaatgactacgaactttggagatgcaacacttgagatcaaagatggaagatttgaaaaagcccttgctaacgcaaagccccccattaactttgacccttatgcaccggaactggaagatggtggtacgtatcaaatagtttctactttaaataatagtagtgtcgttgacttaaatcaagcagatggaaatgttctgttgtggcaaaatggcaacgctaataatcaaaaatggaagctagtatatgattcaagtaaatcagcataccaacttaaaaatatagcaaatcaaaatttagtattagcttggaatgatcttaatggttctaataatgtagttgctacatctaatcaaaataaggaagagcaatattggataccaacagaagcaggaaatggatattattatgtaaggaataagaaggatcaaaacaaagtgttagatgtaagtggttatggtactgcaaatggaacaaatgttacagtatataatttccatggtggtaataatcaaacattccaattgtctaatgtaacagggactttaacaagagaagtggagtcactctataaggcacagcctggtcaaaccagtagatcaagtaataatttttcacttgaacatctcgcggcaggtaccaaagtacgagttgttttagaaggaacaggtgctacctctttgtcatttaacatttcaagagataaatcaggtgcagactctagaatttggtcaaatgttagagatggttctgttctaacgatcctttcaggagatgatagaaaaaatttgtatatctctggtcctcctagcggatatacttctaacggtacatttaaagtgaaattctacgctcttccaaac

SEQ ID NO: 50 - protein, 515 aa, Bacillus thuringiensis
MKLISKIVMTALIVLSTFTFNLGGQFDKSFLSASKAYADVIKALPQNASKIELDYAPVYDYDTDGCYATAAISPDGTTNPGLSLGGSPESVCRDVNRLENSNTYSRAKSNNGWTAIMYASYFEKDQQTSGPVALGHRHDWEHTIVWVKDSQVQYVTYSAHGNWYTNPRSNVRFDGNHPKIVYHKDGGLTHAFRLANSNDEPPENYYHQWLQLPMVGWNGYPSPNIREKLMTTNFGDATLEIKDGRFEKALANAKPPINFDPYAPELEDGGTYQIVSTLNNSSVVDLNQADGNVLLWQNGNANNQKWKLVYDSSKSAYQLKNIANQNLVLAWNDLNGSNNVVATSNQNKEEQYWIPTEAGNGYYYVRNKKDQNKVLDVSGYGTANGTNVTVYNFHGGNNQTFQLSNVTGTLTREVESLYKAQPGQTSRSSNNFSLEHLAAGTKVRVVLEGTGATSLSFNISRDKSGADSRIWSNVRDGSVLTILSGDDRKNLYISGPPSGYTSNGTFKVKFYALPN

SEQ ID NO: 51 - DNA, 2385 bp, Bacillus thuringiensis
atgaaccaaaatcacaacaaaaatgaatatgaaatcatggatacaggtggcatgagctataaaccaaggtacccccttgcgaatgcaccaggttcagaattccaaacaatgaattacaaagattggatggatatgtgtgaatttggggaatcaggagaattatttgcaggttcaaatactgctaggaatggagttattatcggtacaggtattgcatgggcagtccttgcactagttccagctgttggtcctggattatcagcaatagcgggcatattaaatgtagtaattccatacttatggcctgaagaggcaggaccacccggaacttcccaagcgcaatttacgtgggatcagctgatgagtgcggcaggagaacttattgatcaaaaaatttcagacctagttagaaccaatgctattaatacattacgaatattacaatcacgtgtaagagactatcaacaagcaatctgtaatttaaaaaaagacccaaataacgaagcatacaaagcggacgtaagaagggaatttaatgatgctgacgatcaggcgaaatccgctattatcgaattacaaactatcggctatgaaattccattattatctagttatgcgcaagctgccaatttacacttacttttattacgagatgttgtccaatacggagagagttggggattttcaccacttgaagtccaacaatattattctaacactagcgcagtaggaaaccggggcatgttagaactattagaagtatatactgagcattgtattgagtggtataataaaggtttaaataaattaaggcaagaagccggtaattcacctgaagaatggaataagttcaatgatttccgtagggacatgaccataatggcactagatattgtatcattatggccaacttatgatccgaaattctatgcatattctacaaaatcacagcttacacggagtgtgtatacaccaatgtctgggagacttcttcgcggttttgaggatcgtgagaatgctgtaatcccccctccgtctctattttcatggctacgtgaggtaacgttctttagaagagcatttcctgttcctactaatcaggatgcgctatttacgcagtatgctggttataaaatgtcgtttcaaaatactttagatagtacgttacaggaaacaccagtgttcggcacaacaagccaagaagttaatgttgtaaagataggtgaggagcctaattttgaagtttataaaatgagaaacattatactggcaccagaagctagcagaacgtttcaatctcctcaaacatttgattttcactttactccatcaggaacgtttgaaacagttggaatcaattatgccgatatacaggaagagccaacaaatactacgaatcaaggacttgcttgtaacagtgataataaaccttgtgatccttgtacttctacgactccttgtccaactgggcctatcaatactactattccttgtgatagccttagtctttatagtcatcgactgtcatggatgggtagtattattggtgctaatccaggaagtataatccaacttacctacggctggacccacataagtgcagatgcaaccaataggatagacactgaaaagattacccaaattccagcggtgaaggcttctggtggagataatttccaagttataaaaggacctggcagcacaggaggagatttagttgcattgaccacctattctaagataatgataccggtgactgccccaggaaccaaagcatatcacattagaattcgttatgcatgtataggagctgttcggttaagaattggaacatttaacaataatgcatggatatatagcgactatgatatacttagcacgtattctggtagtcagttaacctattcttcatttggatatgagttcattgggtatgtaccaacaacatctacagatattaaaatatctattgaaaatatagctccatttgaaatacctatcatcctcgacaaaatcgaattcattccaattgaaaaatctttggaagaatatcaagcgaatcagaatctagaaaaagcgcggaaggcagtgaatgccttgtttaccaatgatgcgaaaaatgccttgaaattgaacatcacggattatgctgtagatcaagctgctaacctagtcgattgtgtatctgacgaaatctcttcacaagaaaaaatgattttacttgatcaagtcaaatttgcgaaacgacttagtcaagcacggaatctattgaactctggagattttgaatccccagactggtccggagagaatggatggaagacaagtaatcatgtccatgtctctgcagataatccgatctttaaaggacgttatctccatatg

SEQ ID NO: 52 - protein, 795 aa, Bacillus thuringiensis
MNQNHNKNEYEIMDTGGMSYKPRYPLANAPGSEFQTMNYKDWMDMCEFGESGELFAGSNTARNGVIIGTGIAWAVLALVPAVGPGLSAIAGILNVVIPYLWPEEAGPPGTSQAQFTWDQLMSAAGELIDQKISDLVRTNAINTLRILQSRVRDYQQAICNLKKDPNNEAYKADVRREFNDADDQAKSAIIELQTIGYEIPLLSSYAQAANLHLLLLRDVVQYGESWGFSPLEVQQYYSNTSAVGNRGMLELLEVYTEHCIEWYNKGLNKLRQEAGNSPEEWNKFNDFRRDMTIMALDIVSLWPTYDPKFYAYSTKSQLTRSVYTPMSGRLLRGFEDRENAVIPPPSLFSWLREVTFFRRAFPVPTNQDALFTQYAGYKMSFQNTLDSTLQETPVFGTTSQEVNVVKIGEEPNFEVYKMRNIILAPEASRTFQSPQTFDFHFTPSGTFETVGINYADIQEEPTNTTNQGLACNSDNKPCDPCTSTTPCPTGPINTTIPCDSLSLYSHRLSWMGSIIGANPGSIIQLTYGWTHISADATNRIDTEKITQIPAVKASGGDNFQVIKGPGSTGGDLVALTTYSKIMIPVTAPGTKAYHIRIRYACIGAVRLRIGTFNNNAWIYSDYDILSTYSGSQLTYSSFGYEFIGYVPTTSTDIKISIENIAPFEIPIILDKIEFIPIEKSLEEYQANQNLEKARKAVNALFTNDAKNALKLNITDYAVDQAANLVDCVSDEISSQEKMILLDQVKFAKRLSQARNLLNSGDFESPDWSGENGWKTSNHVHVSADNPIFKGRYLHM

SEQ ID NO: 53 - DNA, 2932 bp, Bacillus thuringiensis
atgtatttattcgtcctcattctgcatgagggcttacacatagtatacgagggaggtttatatatgaatcaaaactacaacaacaatgactatgagatcataaatggcgattacaggtacgatacacaaaggtatccttttgcggaagcgccagatttagcagtacaaaacatgaattatcaagatgtgatgaacccatgtatgggaagcacttatactacagatccacaattacaggtccgagaatctgtcagtaaagctgcagacgttgtactgcagcttctcagtttaggtgccccaggactagctgcagctggaggagttatccaatcgatatttggattactttggccagcaccaaataaccaagacgtctggcagggatttataggggcggtagaaacgctcgtatctcaatcaattgacacacttgtacgagatacagcaattaggcaattagagggcctacaaaacatcttggaagaatatgaaattaaccttcagatttttaaggactacccagataacccagtacacgcagaggcattacgaattctagcttttgatatagatggtgcatttgagcaggcaatgcctgaatttacgattaccaatcatgaagtaacattattacccatatatgcacatgcggccaatctccatttagcctttatacgagacgttgtcatgcatggacttacatggggtatgtcacagcaacaaataaactccttttacatgtatgattgtgggggcctagaatatcttacggaagaatatacagattattgtgtgaagtggtataaaaacggtcttgacaaagcctactacttaggaccgaattcaagagattacaacaaatatccatatctagaagattatccaagttatgccagtcaatacctatattacgatccagtggttgattggaatctatataatgattaccgaagatctatgacccttatggtgttagatttagtagcgatatggccaacatatgatccattcctatattcggttcctgttgcaactcagttatcacgagaagtatattctatagcatatgggaaagtgggttctagctggaaaagtcaggatgttgttgagactacttatgtccgtccacctcatctcgttacgtggttaaaagaaatagccattcatatgtcatctaatccttcttcctatctatttgatcaatttgcaggtgtaaaaatcaaactgtcccttacaggctcatctagtacacgggaggacggttttcctcctcttcgatcatactcttctgatcaaagagttacgtctagtaacattggtggtctgagaataggaactggtaatgttatatgcgcagtgaattttctgaatccttcagggtcatcgattaaggcgcttggatattgtgagtcgggtggattccaagaaaatattgttgtacatgatgcaggtatcgataccccttcaagtacgaacccagcctcccatcgtttatcctatataaatgcgatagacgcaagctttactggttatccaggtggtggtgaacatgggctatcatcatggggatttggttggacacataacagtttaacaccagaaaatacaatatctgtggatcgaatatctcaatttccggcggtgaaagcctttgatatatcagatacgggaccaggtaaagtcatcaaaggtcctggtcatacaggaggtgatttagtatctcttccttcaggaggtgcacgggcgaagttgcgtttgattccagaacagcaaggaaaatcctataaagtgagaatccgttatgcatgtgctggaactacgcaactatgggtggagaaatggaccgggaatttttacggtcaaacatatactgttaacgcgacgtataccgatggggtgttagattataatgcatttaaattcttggatgtatataacttctacactggagagcctaattttgaaataattatacaaaacacaggaaattcaactattatcatcgacaaaatcgagttcattccgatagaaggatcagtggaagaatatgaagcgggtcaagatttagaaaaagcacggaaggctgtgaatgccttgtttaccaatgatgcgaaaaatgcattacaattgaatatcactggttatgatgtcgatcaggctatgatgcaagtggaaaatatacctgatgatatgttccaaaaagaaaaaatgattttattgaatcttgtgaaacatgccaagcgtctgagtcaagctagaaatctgttgaaatatggtgattttgaatccccatattggttaggtgagaatggatggaaagcaaataataatgttacggtgacatcagatgatcgaggcgttagccgctatttgaatatgccaggtgcaaatgtggtaggggaacaggtagtcccaacgtttgtgtatcaaaaagtggatgaatcgaagttaaaaccgtatacacgttatttagtacgaggatttgtgagacatagtaaagagttagaactgtttgtgagacgatatggtcaagaagttcatgcggattttccacgcagtctgatggacacatgtaatcagacatcgaatatggcaaacggatatgatgtgagtactgtaccatatactacgatgtcacaagaaggatcttgtaacccatatcgtagtgaatatacgtcaaaggcattagtgatgatggatccaactaccaacggtagctatgaggaaaaacgacattttgtctttcacattgatgtaggtgcaatcgacccgcgagcgaatcttggtatagatattggctttaaaatctcttctccaacaggtatggcccagttaaacaatgtagagattatagaagcgaagccattaacgggcgaagcattagctcgtgtgaaaaaacgggaacagaaatggaaaagagagctggaacaga

SEQ ID NO: 54 - protein, 977 aa, Bacillus thuringiensis
MYLFVLILHEGLHIVYEGGLYMNQNYNNNDYEIINGDYRYDTQRYPFAEAPDLAVQNMNYQDVMNPCMGSTYTTDPQLQVRESVSKAADVVLQLLSLGAPGLAAAGGVIQSIFGLLWPAPNNQDVWQGFIGAVETLVSQSIDTLVRDTAIRQLEGLQNILEEYEINLQIFKDYPDNPVHAEALRILAFDIDGAFEQAMPEFTITNHEVTLLPIYAHAANLHLAFIRDVVMHGLTWGMSQQQINSFYMYDCGGLEYLTEEYTDYCVKWYKNGLDKAYYLGPNSRDYNKYPYLEDYPSYASQYLYYDPVVDWNLYNDYRRSMTLMVLDLVAIWPTYDPFLYSVPVATQLSREVYSIAYGKVGSSWKSQDVVETTYVRPPHLVTWLKEIAIHMSSNPSSYLFDQFAGVKIKLSLTGSSSTREDGFPPLRSYSSDQRVTSSNIGGLRIGTGNVICAVNFLNPSGSSIKALGYCESGGFQENIVVHDAGIDTPSSTNPASHRLSYINAIDASFTGYPGGGEHGLSSWGFGWTHNSLTPENTISVDRISQFPAVKAFDISDTGPGKVIKGPGHTGGDLVSLPSGGARAKLRLIPEQQGKSYKVRIRYACAGTTQLWVEKWTGNFYGQTYTVNATYTDGVLDYNAFKFLDVYNFYTGEPNFEIIIQNTGNSTIIIDKIEFIPIEGSVEEYEAGQDLEKARKAVNALFTNDAKNALQLNITGYDVDQAMMQVENIPDDMFQKEKMILLNLVKHAKRLSQARNLLKYGDFESPYWLGENGWKANNNVTVTSDDRGVSRYLNMPGANVVGEQVVPTFVYQKVDESKLKPYTRYLVRGFVRHSKELELFVRRYGQEVHADFPRSLMDTCNQTSNMANGYDVSTVPYTTMSQEGSCNPYRSEYTSKALVMMDPTTNGSYEEKRHFVFHIDVGAIDPRANLGIDIGFKISSPTGMAQLNNVEIIEAKPLTGEALARVKKREQKWKRELEQ

SEQ ID NO: 55 - DNA, 2956 bp, Bacillus thuringiensis
atgaagataaataatcagaaccaatgcataccatataattgcttaagtaatcctgaggaagtacttttggatggggagaggatattacctgatatcgatccactcgaagtttctatgtcgcttttgcaatttcttctaaataactttgttccagggggggggtttatttcaggattaattaataaaatatggggggctttgagaccatctgaatgggaattatttcttgcacagattgaacagttgattgatcgaagaatagaagcagcagtaagagcaaaagcaatcgctgaattagaaggtttagggagaagttatcaactatatggagaggcatttaaagagtgggaaaaaactccagataacacagcggctcggtctagagtaactgagagatttcgtataattgatgctcaaattgaagcaaatatcccttcgtttcgggtttccggatttgaagtgccacttctatcggtttatacccaagcagctaatttgcatctcgctctattaagagattctgttgtttttggagagagatggggattgacgactacaaatgtcaatgatatctataatagacaagttaagagaattgatgaatatagcgatcattgtgtagatacgtataaaacagaattagaacgtctagagtttagctctatagcgcaatggagaatatataatcagtttagaagggaattgacactaacggtattagatattgtcgctcttttcccgaactatgatggtagactgtatccgattcgaacaatttctcaattgacaagagatatttatacatccccagtaagcgaattttattatggtcccatttataattataatatagttggtcgccttactgaacagcagctaaggcgaccacatcttatggacttctttaactccatgatcatgtatacgtcagataatagacgagaacattattggtcaggacttgaaatgaaggctactgatacttcaggaaaccaagtgtcattccctttagctgggactagagggaattcagctccaccagtaactgttagaaataatggtgagggagtttatagaatattatcagagccattttattcatcaccttttctaggcaccagtgtgctaggaagtcgtggggaagaatttgcttttgcatctaatactactacaagtctgccatctacaatatatagaaatcgtggaacagtagattcattagtcagcataccgccacaagattatagcgtaccaccgcacagggggtatagtcatttattaagtcacgttacgatgcacaatagttctcctatattccactggacgcatcgtagtgcaacccctagaaatacaattgatccagatagtatcactcaaatcccagtagttaaggcttcgcacctctctggtggttcagttataaaagggcctggacatacaggtggagatttaataagcctacctgtaaataactttactcatttccgaatcccatttcaggcaaacactccacaaaggtatcgtattagaattcgttatgcggcagactcagatgggactttggatagtggagttttcttaagtgcagcagcaggggatggttttaatacaacttcttatagggccacaatgagccctggaggttccttaacatctcgtgattttcaatttttagatttaaacacatcgtttacctccgatgtagcatctaacttatggttacattttatacgttatatacgaccagggaatttgtatatagatagagcggaatttatcccagtggatgcaaccttcgaggcaggttataatttagaaagggcgcaaaaggcggtgaatgccctgtttacttctacaaaccaaaaaggattacaaacagatgtgacggattatcatattgatcaagtatccaatctagttgattgtttatctgatgagttttgcttagatgaaaagcgagaattgtccgagaaagtcaaacaggcgaagcgactcagtgatgagcggaatttactccaggattcaaatttcagaggcatcaatagggaacaagaccgtggatggagaggaagtacgcatattactatccaaggaggaaatgatgtattcaaagaaaattttgttacactaccaggtgcctttgatgcgtgttatccaacgtatttgtatcaaaaaatagatgaatctaaattaaaagcctatacacgttatgaattaagaggatatatagaagatagtcaagatttggatatttacttgatccgttacaatacgaaacatgaaacattaaatgttccaggtactaagtctccatggtcgctttgtacggagagcccacttggaaagtgtggggaaccaaatcgatgcgcatcacaaatagaatggaatcctgatctagactgctcttgcagagacggagaaaaatgtgcgcatcattcgcatcatttctccttggacattgatgttggatgtacagatttgaatgagaacctaggtatatgggtgatattcaagattaagacacaggatggtcatgcaagactaggaaatctagaatttctcgaagagaaaccgttattaggagaagcgttagcccgtgtgaagagagcggagaaaaaatggagagacaaacgtgaaaaattgcaatcagaaacaaatattgtttataaagaagcaaaagaagctgtagatggtttattcgtagattcccaatatgagagattacaagctgatacgaatatcgccatgattcatgcggcagataaacacgttcatcaaatccgagaggtttatttcccagagctctctgtgattccaggtgtcaatgcagcgattttcgaagaattagaaggccgtattttcacagcgtattccctatatgatgcgagaaatgtcattaaaaacggtgatttcaataatggcttatcatgctggaacgtgaaagggcatgtagatg

SEQ ID NO: 56 - protein, 985 aa, Bacillus thuringiensis
MKINNQNQCIPYNCLSNPEEVLLDGERILPDIDPLEVSMSLLQFLLNNFVPGGGFISGLINKIWGALRPSEWELFLAQIEQLIDRRIEAAVRAKAIAELEGLGRSYQLYGEAFKEWEKTPDNTAARSRVTERFRIIDAQIEANIPSFRVSGFEVPLLSVYTQAANLHLALLRDSVVFGERWGLTTTNVNDIYNRQVKRIDEYSDHCVDTYKTELERLEFSSIAQWRIYNQFRRELTLTVLDIVALFPNYDGRLYPIRTISQLTRDIYTSPVSEFYYGPIYNYNIVGRLTEQQLRRPHLMDFFNSMIMYTSDNRREHYWSGLEMKATDTSGNQVSFPLAGTRGNSAPPVTVRNNGEGVYRILSEPFYSSPFLGTSVLGSRGEEFAFASNTTTSLPSTIYRNRGTVDSLVSIPPQDYSVPPHRGYSHLLSHVTMHNSSPIFHWTHRSATPRNTIDPDSITQIPVVKASHLSGGSVIKGPGHTGGDLISLPVNNFTHFRIPFQANTPQRYRIRIRYAADSDGTLDSGVFLSAAAGDGFNTTSYRATMSPGGSLTSRDFQFLDLNTSFTSDVASNLWLHFIRYIRPGNLYIDRAEFIPVDATFEAGYNLERAQKAVNALFTSTNQKGLQTDVTDYHIDQVSNLVDCLSDEFCLDEKRELSEKVKQAKRLSDERNLLQDSNFRGINREQDRGWRGSTHITIQGGNDVFKENFVTLPGAFDACYPTYLYQKIDESKLKAYTRYELRGYIEDSQDLDIYLIRYNTKHETLNVPGTKSPWSLCTESPLGKCGEPNRCASQIEWNPDLDCSCRDGEKCAHHSHHFSLDIDVGCTDLNENLGIWVIFKIKTQDGHARLGNLEFLEEKPLLGEALARVKRAEKKWRDKREKLQSETNIVYKEAKEAVDGLFVDSQYERLQADTNIAMIHAADKHVHQIREVYFPELSVIPGVNAAIFEELEGRIFTAYSLYDARNVIKNGDFNNGLSCWNVKGHVD

SEQ ID NO: 57 - DNA, 1947 bp, Bacillus thuringiensis
atggagagaaataatcaggatcaatgcattccttataattgtttgaataatcctgaggttgggatattagatattgaaaatttcaatctcgaacttgtatcgcaagtcagcgtggggctcacacgttttcttttggaagcatctatccctggggcaggttttgcattgggtctattcgacatcatttggggtgctctaggcgtcgatcaatggagcttattccttgcgcaaattgagcaattaattaatgaaagaataacaacagtagaaaggaatagagcgattcaagcattaagtggactatcgagtagttatgaagtatatattgaggcattaagagaatgggagaatgatctggataatccagcttcacgagatagagtggttgcacgttttcgtgcaacagataattctctaataacagatatacctctattggaaattccaggttttgagatagctactttatcagtctatactcaagcggcgaatctacatttagctttgttaagagatgccgtttactttggagaaagatggggattaacacaaacaaatattgaagatctgcacacaagactcacgagatatattcaagaatactcagaccattgcgcaagatggtataatcaaggtttgaataatattggagggataaatacaagatatttggacttccaaagagaattaacaatttcggtcttagatattgtcgctcttttcccaaattacgacatccgaacatatccaattccgacacaaagccaattaacaagggaaatatatacatctcccgtcgttgcacctggtgtaaattggattttaagtatatcgaatgtattgagagcccctcatctgatggatttttttgatcgaataattatttatactggtacagttagaagtacaccacattgggaagggcatgaagtcatatctagaagaacagggcaaggaaatgagatacgctcgcctttatatggagtggctgcaaacgcagaaccaccagttactataagacctacaggatttactgatgagcaaagacaagtgtatagagtactatcacgtgttgcttcttttagaaattcaggaaccaactttagtctggtagatgcagcatcattcctaactatatttagcgctagctcaatctatagaaatggttttgggtttaatgctgatactattgatgaaattccaattgaggggactgatccatatattggatatagccatcgattatgccatgttggatttactgcgtcatctccatttatctcccagtatgcaagggcgcccgtattttcttggacgcatcgtagtgcgacttttacaaatacaattgatccagagaggattacgcaaataccaatggtaaaagcatacaatcttcatgcaggtgccactgttgttagaggacccgggtttacaggtggtgatctcttacgaagaacgaatactggtacatttgcagatataagagtaaatattactgggccattatctcaaagatatcgtgtaagaattcgctatgcttctacgacagatttacaatttttcacgagaatcaatggaacttctgtaaatcaaggtaatttccaaagaactatgaatagaggggataatttagaatctggaaactttaggactgcaggatttagtacgccttttagtttttcaaatgcgcaaagtacattcacattgggtactcaggctttttcaaatcaggaagtttatatagatcgaattgaatttgtcccggcagaagtaacattcgaggcagaatctgatttagaaagagcgcaaaaggcggtgaatgccctgtttacttctacaagccaactagggctaaaaacaaatgtaacgggttaccatattgatcaagtgtccaatttagttgcgtgtttatcggatgaattttgtctggatgaaaagagagaattg

SEQ ID NO: 58 - protein, 649 aa, Bacillus thuringiensis
MERNNQDQCIPYNCLNNPEVGILDIENFNLELVSQVSVGLTRFLLEASIPGAGFALGLFDIIWGALGVDQWSLFLAQIEQLINERITTVERNRAIQALSGLSSSYEVYIEALREWENDLDNPASRDRVVARFRATDNSLITDIPLLEIPGFEIATLSVYTQAANLHLALLRDAVYFGERWGLTQTNIEDLHTRLTRYIQEYSDHCARWYNQGLNNIGGINTRYLDFQRELTISVLDIVALFPNYDIRTYPIPTQSQLTREIYTSPVVAPGVNWILSISNVLRAPHLMDFFDRIIIYTGTVRSTPHWEGHEVISRRTGQGNEIRSPLYGVAANAEPPVTIRPTGFTDEQRQVYRVLSRVASFRNSGTNFSLVDAASFLTIFSASSIYRNGFGFNADTIDEIPIEGTDPYIGYSHRLCHVGFTASSPFISQYARAPVFSWTHRSATFTNTIDPERITQIPMVKAYNLHAGATVVRGPGFTGGDLLRRTNTGTFADIRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKREL

SEQ ID NO: 59 - DNA, 2358 bp, Bacillus thuringiensis
atgaacaagaataatactaaattaagcacaagagccttaccaagttttattgattattttaatggcatttatggatttgccactggtatcaaagacattatgaacatgatttttaaaacggatacaggtggtgatctaaccctagacgaaattttaaagaatcagcagttactaaatgatatttctggtaaattggatggggtgaatggaagcttaaatgatcttatcgcacagggaaacttaaatacagaattatctaaggaaatattaaaaattgcaaatgaacaaaatcaagttttaaatgatgttaataacaaactcgatgcgataaatacgatgcttcgggtatatctacctaaaattacctctatgttgagtgatgtaatgaaacaaaattatgcgctaagtctgcaaatagaatacttaagtaaacaattgcaagagatttctgataagttggatattattaatgtaaatgtacttattaactctacacttactgaaattacacctgcgtatcaaaggattaaatatgtgaacgaaaaatttgaggaattaacttttgctacagaaactagttcaaaagtaaaaaaggatggctctcctgcagatattcttgatggtttaactgagctaactgaactagcgaaaagtgtaacaaaaaatgaagtggatggttttgagttttaccttaatacattccatgacgtaatggtaggaaataatttattcggacgttcagctttaaaaaccgcttcggaattaatcgctaaagaaaatgtgaaaattagtggcagtgaggtaggaaatgtatataatttcttaattgtattaacagctctgcaagcaaaagcttttcttactttaacaacatgccgaaaactattaggccgagcagatattgattatacttccattatgaatgaacatctaaataaggaaaaagaggaatttagagtaaacatccttcctacactttctaatactttttctaatcctacctatgcaaaagctaaaggaagcgatgaagatgcaaagatgattgtggaagctaaaccaggatatgctttggttggatttgaaatgagcaatgattcaataacagtattaaaagcatatcaggctaagctaaaacatgattatcaagttgataaggattcgttatcggaaattgtctattgtgatatggataaattattctgctcggatcgatctaaacaaatatattatacaaataacatagcatttcctaatgaatatgttattactaaaattactttcactaaaaaaatgaacactttaagatatgaggtgacagctaacttttatgattcttctactgggaatattgatttaagtaagaaaaaaatagaatcaagtgaagcgaagtatagtacgttaagtgctagtaatgatggggtttatttgccgttaggtattattagtgaaacattcttgactccaattaacgggtttgggctcgtagtcgatgaaaggtcaagattagtaaatttaacatgtaaatcatatttaagagaggtattgttagcaacagacttaaagaataaagatactcaattgattgtcccacctaatggctttattagcaatattgtaaaaaacggggacttaaagggagacaatttagacccgtggaaagcaaataataaaaatgcgtatgtaaatcatacaggtggtgtgaatggaactaaagctttaactgttcatggggatggtgagttctcaaattttattggtgataagttgacatcgaaaacacaatatgtatttcaatatactgtaaaaggaaaggcttctatttatttaatagataaaaaaaatggcgatgtcatttacgaagatacaaataacgatttagaagattttcagacttttattaaacgttttactaccggaacgaatttttcaggagcttatttgatttttaatagtcaaaatggcgatgaagcttttggagacaactttattatctcagaaattaggcctttagaagagttattaagtccagaattaataaaatcggatgcctgggttcgatctcagggtgcttctggtagtggaaactctctctttattagtagtaatacaaatggaacctttagacaaaatcttccgctagaaaactattcaacttatagtatgaactttaatgtgaatgggtttggcaaggtgacaataagaaattctcgcgaagtagtatttgaaaaaacatatcatcagtttacacctatagatatttctgaaaaattcacaacaaccaataatactggattatatgtagaactttctcgtggcactgggtctgggactataaatttccgagacttttcaattaaa

SEQ ID NO: 60 - protein, 786 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDGLTELTELAKSVTKNEVDGFEFYLNTFHDVMVGNNLFGRSALKTASELIAKENVKISGSEVGNVYNFLIVLTALQAKAFLTLTTCRKLLGRADIDYTSIMNEHLNKEKEEFRVNILPTLSNTFSNPTYAKAKGSDEDAKMIVEAKPGYALVGFEMSNDSITVLKAYQAKLKHDYQVDKDSLSEIVYCDMDKLFCSDRSKQIYYTNNIAFPNEYVITKITFTKKMNTLRYEVTANFYDSSTGNIDLSKKKIESSEAKYSTLSASNDGVYLPLGIISETFLTPINGFGLVVDERSRLVNLTCKSYLREVLLATDLKNKDTQLIVPPNGFISNIVKNGDLKGDNLDPWKANNKNAYVNHTGGVNGTKALTVHGDGEFSNFIGDKLTSKTQYVFQYTVKGKASIYLIDKKNGDVIYEDTNNDLEDFQTFIKRFTTGTNFSGAYLIFNSQNGDEAFGDNFIISEIRPLEELLSPELIKSDAWVRSQGASGSGNSLFISSNTNGTFRQNLPLENYSTYSMNFNVNGFGKVTIRNSREVVFEKTYHQFTPIDISEKFTTTNNTGLYVELSRGTGSGTINFRDFSIK

SEQ ID NO: 61 - DNA, 2445 bp, Bacillus thuringiensis
atgggaaataggagggaatttatgaataacgaaacacaaaatcaatgcatcccttataattgtttaagtaaccctgaagtggagatattaggaggagacagaagtgctggtattctgccaatacaaatctctctatcgttaacgcgtttccttgctggcgaatttatcccaggagtgggagttgcacttgggttatttgatttaatatggggatttataagtccttctgattgggatcaatttcttgtacggattgaacaattaattgatcaaagaatagaagaattagaaagaactagagcactctctgcattacaaggactagcgaatagttatggggtgtatgttgaagcgcttagagcgtgggaggctgatcctaataatgaagcattaaaggaagatgtgcgtactcgatttactagtattgatggtgatttaatagcagagattcctagatttagacttagaggttatgaggttcctctgttatcggtatatgttcaagcaactaatttacatttatctatgttaagagattctgtaagtcttgggctgcggtggggatttgatattgccacgattaataatcattataacagattaattaataatattcgtgagtatacagattatagtgtgagcacatacaatataggattagaacgcttaaggggaactcgtgttcaagattgggtaaagtttaatcagtttaggagggaactaacacttactgtgttagatattgtttctctttttccaaactatgatgtcagaacatatccaattcaaacagtatcacaattaactagagaaatttatacaaatcctgtatttgaaaattcaccagttaatattaatcttgttaatggctttaatagagttgagtacggagtccgacaacctcatcttatggatcacctcatgaatgtatctatttctgaagaagattatagaggggacaccttttggggaggtcactctattgcctccgtagatacgggtggtaatcttgtcggtttcccgttttatggtaatttcgatagatttcgttttcaaacaatcaacgctcaacaatttcctctttttagaacgttatcagatcctgtttataacctcagtacatctggagggagaaacagactatttgctcttgaagggataggatttcaacaggctgtaacgggaaccacacgagcttttaggagagtcggaacaatagattctcttattgaaataccacctcaagatgaaagtgaagtaccttggaatggctatagtcatgtattaaatcatattacatttataaattggccagctgttttcctacaaggggaaagaatagcttctccaatgttttcttggacacatcgtagtgcagatcgtatcaatagaattattccagatgttatcaatcaaattccagctgttaaaggcagctctattattaatggaactgtaatttcaggaccaggatttactggaggagatttagttagattagaaaataatgcataccttgaaattccagtgcaatttcaaacaacatctacaaattatcgagttcgtgtacgttatgcctccacctctcaagcatctataagtgtagtttttggaaatatagatcatcctagtaccataccagccacagctgaatcattagacaatctacaatataacgattttgattattttgatgttattggtactttcttaccttcattaggcggtagtttagcttttagaactttaagttcgaatgcaaatgtggtaatagatagattcgaatttatcccagttactgcaacatttgaggcagaatatgatttagaaaaagcgcaagaggcggtgaatgctctgtttacttcttccaatcaaatagggttaaaaacagatgtgacagactatcatattgatcaagtgtccaatctagttgaatgtttatcggatgaattctgtctggatgaaaaaagagaattgtccgagaaagtcaaacatgcgaagcgactcagtgatgagcggaatttactacaagatcaaaacttcagaggcattaatgggcaaccagaccgtggctggagaggaagcatgggtattaccatccaaggaggagatgatgtattcaaagagaattacgtcacactaccaggtacctttgatgagtgctatccaacgtatttgtatcaaaaaatagatgagtcgaaattaaaagcctatacccgttatcaattaagaggatatatcgaagatagtcaagacttagaaatctatttgattcgttacaatgcgaaacatgagacattaaatgttccgggtacgggttctttatggccgctttcagtcgaaagtccaattggaaagtgcggagaaccggatcgatgcgcaccacatattgaatggaattctgatctagattgttcctgtagagatggagaaaaatgtgcacat

SEQ ID NO: 62 - protein, 815 aa, Bacillus thuringiensis
MGNRREFMNNETQNQCIPYNCLSNPEVEILGGDRSAGILPIQISLSLTRFLAGEFIPGVGVALGLFDLIWGFISPSDWDQFLVRIEQLIDQRIEELERTRALSALQGLANSYGVYVEALRAWEADPNNEALKEDVRTRFTSIDGDLIAEIPRFRLRGYEVPLLSVYVQATNLHLSMLRDSVSLGLRWGFDIATINNHYNRLINNIREYTDYSVSTYNIGLERLRGTRVQDWVKFNQFRRELTLTVLDIVSLFPNYDVRTYPIQTVSQLTREIYTNPVFENSPVNINLVNGFNRVEYGVRQPHLMDHLMNVSISEEDYRGDTFWGGHSIASVDTGGNLVGFPFYGNFDRFRFQTINAQQFPLFRTLSDPVYNLSTSGGRNRLFALEGIGFQQAVTGTTRAFRRVGTIDSLIEIPPQDESEVPWNGYSHVLNHITFINWPAVFLQGERIASPMFSWTHRSADRINRIIPDVINQIPAVKGSSIINGTVISGPGFTGGDLVRLENNAYLEIPVQFQTTSTNYRVRVRYASTSQASISVVFGNIDHPSTIPATAESLDNLQYNDFDYFDVIGTFLPSLGGSLAFRTLSSNANVVIDRFEFIPVTATFEAEYDLEKAQEAVNALFTSSNQIGLKTDVTDYHIDQVSNLVECLSDEFCLDEKRELSEKVKHAKRLSDERNLLQDQNFRGINGQPDRGWRGSMGITIQGGDDVFKENYVTLPGTFDECYPTYLYQKIDESKLKAYTRYQLRGYIEDSQDLEIYLIRYNAKHETLNVPGTGSLWPLSVESPIGKCGEPDRCAPHIEWNSDLDCSCRDGEKCAH

SEQ ID NO: 63 - DNA, 1839 bp, Bacillus thuringiensis
atggctcaggatccctttagttttcaacataaatcattagatactatacaaaaagaatggacggaatggaaaagagatgatcatagtttatatgtagctcctgttgttggaactgttgcaatttttctgctaaagaaattgggggggttcgctgcaaaaaggatattgaatgggttatgggatttagtatttcctaatgataataccaaactaatgcaagatattttaagagagacagaaaaatttctaaaccaaagacttaatgcagacactctttctcgagtaaatgcagaattggaggggcttcaaaaaaatgtagcggagtttaatagacaagtggataattttttaaatcctaatcgaaacccgactcttttatcaataacttcttcagttaatacaatgcaacaattgttcctaaatagattaacgcagttccagttacgaggatacgagctgttattattacctttatttgcacaagcagccaatttacatctttcctttattagggacgttattctgaatgcagaggaatgggggatttcagcagcaacgttacgcacatatcgaggttacctaaaagactatacaaaagaatactctaattattgtataaatacgtatcaaaccgcatttaaaaagttaaatactcctttacacgaaatgttagagtttagaacatatatgtttttaaatgtatttgaatatgtatccatttggtcattgtttaagtatcagagtcttctggtatcttctggcgcaaatttatatgctagtggtagtgggccacagcagaaacaatcatttagcgcgcagaactggccatttttatattcccttttccaagtgaattctaattatgtattaactggttttagtggttttaggaattcttttaccatgcctaatattggtggtttccccggttctactacaactcacgcattgtttagtgcgagggctaattatagtggaggaatttcatctggtatcatagggatgactaatagtaatcacaactttaattgtagcaccgcttctttacaaacaccatatactagaagttggctggattcaggtagagatcaacatgccattaatacctttacagattggcagacagaatgttttcaaacaacttcggattcctggtgtggtgcctttgtcccccgtggtaatacgaattatttcccagattattttattcgtaatatttctggagtttctttagttgtcgggaatgaagatttaagaagaccgttacactataatgaaataagaaatatagcaagtccttccggaacccctggtggagggcgagcttatatggcatctgtgcacaacagaaaaaataatatctatgccgctcatgaaaatggtactatgattcatttggcgccggatgataatacagggtttattatatcgccgatacatgcaacacaagtaaatacgcagaatcgaacatttatttccgagaaatttggaaatcaaggtgattccttacgatttgaacaaacaaacacaacagctcgatacacatttaggggaaagggcaatagttataatctgtatttaagagtatcatctttaggaaattccactattcgagttacgataaacggtaaggtttatactgttccaaatgttaataccactacaaataatgatggggttattgataatggatcacgtttttcagatgtttacatcggtaacgtagtagcaaatgataagacgaatgtaccgttagatataaatgtgacatttaattctggtactcaatttgagcttatgaatattatgtgtattccaactaatattacaccactttat

SEQ ID NO: 64 - protein, 613 aa, Bacillus thuringiensis
MAQDPFSFQHKSLDTIQKEWTEWKRDDHSLYVAPVVGTVAIFLLKKLGGFAAKRILNGLWDLVFPNDNTKLMQDILRETEKFLNQRLNADTLSRVNAELEGLQKNVAEFNRQVDNFLNPNRNPTLLSITSSVNTMQQLFLNRLTQFQLRGYELLLLPLFAQAANLHLSFIRDVILNAEEWGISAATLRTYRGYLKDYTKEYSNYCINTYQTAFKKLNTPLHEMLEFRTYMFLNVFEYVSIWSLFKYQSLLVSSGANLYASGSGPQQKQSFSAQNWPFLYSLFQVNSNYVLTGFSGFRNSFTMPNIGGFPGSTTTHALFSARANYSGGISSGIIGMTNSNHNFNCSTASLQTPYTRSWLDSGRDQHAINTFTDWQTECFQTTSDSWCGAFVPRGNTNYFPDYFIRNISGVSLVVGNEDLRRPLHYNEIRNIASPSGTPGGGRAYMASVHNRKNNIYAAHENGTMIHLAPDDNTGFIISPIHATQVNTQNRTFISEKFGNQGDSLRFEQTNTTARYTFRGKGNSYNLYLRVSSLGNSTIRVTINGKVYTVPNVNTTTNNDGVIDNGSRFSDVYIGNVVANDKTNVPLDINVTFNSGTQFELMNIMCIPTNITPLY

SEQ ID NO: 65 - DNA, 2067 bp, Bacillus thuringiensis
atgaaaccaaagaatcaaaataagtatcaaagtttatcgaaaaatgcgacagttgataaaatctctacggattcactaaaaaatgaaacagatagagaattgaaaaatatttataatgaagattgtttgagaatgtctgagcatgaaagtatggagccgtttgttagtgcatcaacaattcaaacggggattggtattgctggtaaaatccttggtaacctaggcgttccttttgctggacaagtagctagcctctatagttttatcctagatgagctttggcccaaagggaaaagccaatgggaaatctttatggaacatgtagaagagcttattgctcaaaaaatatcgacttacgccagaaacaaagcacttgcagatttaaaaggattaggggatgctttggctgtctaccatgagtcgctggaaagttggattaaaaatcgcaataacacaagagccagaagtgttgttaagaaccaatacatcgctttagaacttatgtttgtgcaagcgttgccttcttttgcagtgtctggagaggaagtaccactattaccaatatatgctcaagctgcaaatttacacttgttgctattaagagatgcgtctatttttggaaaagagtggggattatccgactcagaaatttccacattttataatcgccaatctggaaggtcgagggaatattctgaccactgcgtaaaatggtataatacaggcctaaatcgcttgaggggaacaaatgccgaaagttgggtacgttataatcaattccgcagagacatgactttaatggtactagatttagtcgcactattcccaagctatgatacacatatgtatccaattaaaactacagcccaacttacaagagaagtttatacaaatccaattggtgtcgtaggaggagtttcttggtttgaaaacgccgcttctttcgccgctatagaaaacgcagttattcgacaacctcatctatacgattttatgactgaccttaccatttacacgagactaagtcgagcactccctcgttatatgaatttgtgggcggggcatagaatcaattttaatacaattcgtggttctactagtcgcgaaatggtgtatggagctattactaatccagttagtactactcccctttcatttgtcaatcaagatatttatagaactcaatcaatagctggagtacttctcaatctttcaagcagattttacggcgtacctagagttgattttgatataagaaatcgtaactatcctaatataatcaatagactaacttataatcctggatacgcagaaattgcaactcaagtaaaagattcagaaactgaattaccgcctgaaacaacagaacagccaaattatgaagctgctagtcatctgctatgtcatattggaatgcctccaacggggtccggaactggttcagcaactcctccagtatattcttggacacaccggagtgcgggtcgtacgaatatcattaattcggatagtattacacaaatcccattagtaaaggctaataaccttcattcaggcgctactgtcgtcaagggcccaggatttacaggaggagacatactccgaagaactagcgcgggtacatttgtggatttaccagttaatcttattagttggcaattatcacaaagttatcgcgtaaggatacgttatgcttctactacggatttacaatttcatacgtcaattaacgggagagcaattaatcaggggaatttttcagcaactatgaatagaggagatgccttagaatctagaacctttagaactgtagggtttactactccttttaacttttcagatgcgcaaagtacattcacaataagtgcttggaacttctcttcaagtaacgaagtttatatagatagaattgaatttgttccagcagaagtaacattagaggcagaaagtttagaaagagcgcaaaaagcggtaaataatctgtttactccaacagacgtgacggactctcatatagaccaagtatccaatctagtagagcatctatcggacgaactctgtctcaat

SEQ ID NO: 66 - protein, 689 aa, Bacillus thuringiensis
MKPKNQNKYQSLSKNATVDKISTDSLKNETDRELKNIYNEDCLRMSEHESMEPFVSASTIQTGIGIAGKILGNLGVPFAGQVASLYSFILDELWPKGKSQWEIFMEHVEELIAQKISTYARNKALADLKGLGDALAVYHESLESWIKNRNNTRARSVVKNQYIALELMFVQALPSFAVSGEEVPLLPIYAQAANLHLLLLRDASIFGKEWGLSDSEISTFYNRQSGRSREYSDHCVKWYNTGLNRLRGTNAESWVRYNQFRRDMTLMVLDLVALFPSYDTHMYPIKTTAQLTREVYTNPIGVVGGVSWFENAASFAAIENAVIRQPHLYDFMTDLTIYTRLSRALPRYMNLWAGHRINFNTIRGSTSREMVYGAITNPVSTTPLSFVNQDIYRTQSIAGVLLNLSSRFYGVPRVDFDIRNRNYPNIINRLTYNPGYAEIATQVKDSETELPPETTEQPNYEAASHLLCHIGMPPTGSGTGSATPPVYSWTHRSAGRTNIINSDSITQIPLVKANNLHSGATVVKGPGFTGGDILRRTSAGTFVDLPVNLISWQLSQSYRVRIRYASTTDLQFHTSINGRAINQGNFSATMNRGDALESRTFRTVGFTTPFNFSDAQSTFTISAWNFSSSNEVYIDRIEFVPAEVTLEAESLERAQKAVNNLFTPTDVTDSHIDQVSNLVEHLSDELCLN

SEQ ID NO: 67 - DNA, 2223 bp, Bacillus thuringiensis
atgagtccaaataatcaaaatgaatatgaaattatagatgcgacaccttctacttctgtatccaatgattctaacagatacccttttgcgaatgagcccacaaatgcattacaaaatatgaattataaggattatttaagaatgtctgaggggtatgatagtgaatattctggttcacctggagcacttgttagtggaaaacaagcaattaaggttggaatcgatattgtcggcaacatattaggtaagttaggagttccgtttgttcctcagatagtaagtttttataattttattctcgatcagctatggccatcaaattctgtgagtgtatgggaacagattataacgctagtggaagaacttgtagatcaaaaaataacagaatatgcaagaaataaagcactcgctgaattaaaaggattaggagatgctttgggtgtatatcagcaatcacttgaagcatggttggaaaatcgcaatgacacgagagctagaagtgttgtttctaatcaatttatagctttagaactggattttgttggagcaattccatcctttgcagtatccgggcaggaagtaccattattagcagtatatgcacaggctgtgaacatgcacttattgttactaagagacgcttctatttttggagaagagtggggattcacatcatctgaaatttccacttactacaaccgtcaagtgcaactcacttctcaatattccgattattgtgtgaagtggtacgataccggtttacagaaattaaaaggtacgagcgctgagagttggctggagtatcatcaattccgcagagagatgactttcatggtattagatttggttgcattatttccaaactacaatacacacacgtatccacttgaaacaaaggctcaacttacacgagaagtatataccgatccgatcgcctttaatctttctggggcagcgggtttttgtagaccttggtcaaagtatactggtatttccttttcggagattgaaaatgctgtaattcgtccacctcatttatttaatgtactcagtagtttagaaattaatacagttagggggacaattttaggtagcactacagcgtacctaaactattggtcaggtcattctctacaatataattttataggtaatacaacagtcagggaaagtaattatggatatcttacttcagaaaaaactaggattcaattagacactagagatatttttgaaattaattcaactgccgctagcttagcgaattactatcaagagacttatggtgtgccagaatctaggttccatttggtgagatgggctagcccatattatacatcatctcatctttattctaaaacacatacaactggagaaggttgtacacaagtttatgaatcaagtgaggaaatacctgtagacagaaccgtaccggtaaatgaaggttatagtcacagactatcgtatgtcaccgctctctttttccagaaatttattaatactttttatacaaatggaactctacctgtctttgtttggacacatcggagtgcggatctcaccaatacaatttatccggataaaatcacgcaacttccaatagtaaaatcatacactttaccttcaggtacttccgtaatacagggtcctggatttacaggaggaaatatattaaaaagaacaagcactggcagaataggaacttttcgaattaacttaaccggaccattgacacaaagatatcgtgtaagaattcgttatgcttcttctagtgatataaatttccgtgtaattcatgcgggtaagacggttaatgagtattcctttagtaaaactatgaatcaaggagcatctttaacatatgaaacatttaaatttgctagctttactacgcctttcagatttgaaaatacttcaggtgaaatagggatagatgtgtataattttctctcaagtggagaagtttatgtagaccgaatcgaagtcatcccagtagatgcgacatatgaagcggaacaagatttagaggcggcaaagaaagcagtgaatgccttgtttacgaatacaaaagatggcttacgaccaggcgtaacggattatgaagtgaatcaagcggcaaacttagtggaatgcctatcggatgatttgtatccaaatgaaaaacgtttgttatttgatgcggtgaaagaggcaaaacgactcattcaggtacgcaactcgctt

SEQ ID NO: 68 - protein, 741 aa, Bacillus thuringiensis
MSPNNQNEYEIIDATPSTSVSNDSNRYPFANEPTNALQNMNYKDYLRMSEGYDSEYSGSPGALVSGKQAIKVGIDIVGNILGKLGVPFVPQIVSFYNFILDQLWPSNSVSVWEQIITLVEELVDQKITEYARNKALAELKGLGDALGVYQQSLEAWLENRNDTRARSVVSNQFIALELDFVGAIPSFAVSGQEVPLLAVYAQAVNMHLLLLRDASIFGEEWGFTSSEISTYYNRQVQLTSQYSDYCVKWYDTGLQKLKGTSAESWLEYHQFRREMTFMVLDLVALFPNYNTHTYPLETKAQLTREVYTDPIAFNLSGAAGFCRPWSKYTGISFSEIENAVIRPPHLFNVLSSLEINTVRGTILGSTTAYLNYWSGHSLQYNFIGNTTVRESNYGYLTSEKTRIQLDTRDIFEINSTAASLANYYQETYGVPESRFHLVRWASPYYTSSHLYSKTHTTGEGCTQVYESSEEIPVDRTVPVNEGYSHRLSYVTALFFQKFINTFYTNGTLPVFVWTHRSADLTNTIYPDKITQLPIVKSYTLPSGTSVIQGPGFTGGNILKRTSTGRIGTFRINLTGPLTQRYRVRIRYASSSDINFRVIHAGKTVNEYSFSKTMNQGASLTYETFKFASFTTPFRFENTSGEIGIDVYNFLSSGEVYVDRIEVIPVDATYEAEQDLEAAKKAVNALFTNTKDGLRPGVTDYEVNQAANLVECLSDDLYPNEKRLLFDAVKEAKRLIQVRNSL

SEQ ID NO: 69 - DNA, 2448 bp, Bacillus thuringiensis
atggcaaagactaactcttacaaaaaattaatcgctggtacaatgacagcagcaatggtagcaggcgttgtatctccagtagcagcagcaggtaaatcattcccagacgttccagctgatcactgggcattagattctattaactacttagtagaaaaaggcgcaattaaaggtacagatcaaggtacattcgctcctgaacaagaagtaactcgtgcagaagcagctacaatgatggctatcacattaaacttaccaatcgaagagaacgctaaaccaacttacaaagatgctcaaaaccactgggcttcaaaatacatcgcagctgtagaaaaagctggtgtagttgcaggtaaaggcgacggcacattcgctccagacggaaaaatcaaccgcgtttcaatggcagcaatgcttgtaccagctttcaaattagacactaaagtagctggtactccagaaactaaattcgaagatttaaaacctagctggggtaaagacaaagctaacatcctagttgaattaggaatttctgcaggtactacaactactacttgggagcctgaaaaaactgtaactaaagcagaagcagctcaattcattgctaagactgacaagcagttcggacaaaaagaagaagctaaagttgagtctattaaagcaatcaatgctaaagagatcgaagttaaacttggcgctacagtgaaagaagaagatgtgaagaacgcgaaattcactctttctcaaggaactaacgcaacagcagttactacaaaaatcggtgaagataaaaaatctgtaatcgtaactttagatggagatgcaaaacttaaaaataaagaagcatacgttctaactgttgaaggcttaaaagctgctgatggtaaagaaattccaaaagcattagaagttatcttctttaatgacgaagtagctccaactgtatctacagtgtctactccagacggaaaagttaaagtagtatttagtgaaaaattagatacagcaaaagctgtaactgtaatcgttaatggtcaaaaagtagacggaaaagttgaaaataatactttcacttctactaacactttaaaccttgagaacggtaaagaattctcagttatcgtaacgggtgctcaagatttatcaggtaacgaaatggaaatgtacgaaggtaaagctacttacaaagtagaaaaagacgttacagctccagaagtaaaagaaattaaagtaaaagaccttgctaatggtacagctacattagaagctacatttacagaggaactttctgcacaaggtacagtagttgtaaaaaaaggtaatacagtagtaaaagaggctacaattgctcttgatcaagataaaacaaaagcgcttgttacagtaccgggtgctcttacagataaagaaacagctgcagatcttacagttgaatttgttggctacaaagatttagcaaacaatgtaggtactaaagtatctaaagcagtaaaagttacaaaagatgttgtagctcctaacttagttaaagttgtggcagatcaaaataaagaagctacatttacttttgataaagatgtaactaaacaagacggaaaaattcgtgtaatcaatttagatacaagcagagatgtaactggtgaagtgacaatcgaagcagcaaaagacaacagcaaaggtattacattaacattcccagcaaaaggtaactacaaagtagctgctacaaaaggtcttgtaaaagatgcagctggtaatgagtctgcagcatttactaaagaagtgaaagttgtagaaaaagaatctgaaaaagaaacagataaagtagctccagcagtaacaggcgtggcttttgataaagctacaaataaaattacagtaaactttgataaagaagtaaaaggtggccaagtagctgaatcagcttctaatgtaaacaattacacattagctggtgctaaattaccagaaggtgctctaatcgtattagacggtacaaatgcagttattgagttaccatctacatttactttcgaaaaatcagaaacagttaaatttacagtagctaatgttgcaaacaaagacggagtgaaaatgggtacgaaaaacctattattaaacgttgtagatacaaaagctcctgaattccagtcagctaaaattacaaaagttgacgctaaagaaattactttaacattctctgaagctgtgaacgttgatgcaactgactttgttattgacctaaatggtgtggcgttaacagtagcaaaagctgatgacaaagcagctaaagaagtagtacttaaagtaacagctccaacagatgttaacttagcaactggtacattaacacttaaaactaaagaacttaaagataatgcaactttaaatacagttgatacagcagctaacaaacttgttgctttcaaaccagtaacagtagctcgc

SEQ ID NO: 70 - protein, 816 aa, Bacillus thuringiensis
MAKTNSYKKLIAGTMTAAMVAGVVSPVAAAGKSFPDVPADHWALDSINYLVEKGAIKGTDQGTFAPEQEVTRAEAATMMAITLNLPIEENAKPTYKDAQNHWASKYIAAVEKAGVVAGKGDGTFAPDGKINRVSMAAMLVPAFKLDTKVAGTPETKFEDLKPSWGKDKANILVELGISAGTTTTTWEPEKTVTKAEAAQFIAKTDKQFGQKEEAKVESIKAINAKEIEVKLGATVKEEDVKNAKFTLSQGTNATAVTTKIGEDKKSVIVTLDGDAKLKNKEAYVLTVEGLKAADGKEIPKALEVIFFNDEVAPTVSTVSTPDGKVKVVFSEKLDTAKAVTVIVNGQKVDGKVENNTFTSTNTLNLENGKEFSVIVTGAQDLSGNEMEMYEGKATYKVEKDVTAPEVKEIKVKDLANGTATLEATFTEELSAQGTVVVKKGNTVVKEATIALDQDKTKALVTVPGALTDKETAADLTVEFVGYKDLANNVGTKVSKAVKVTKDVVAPNLVKVVADQNKEATFTFDKDVTKQDGKIRVINLDTSRDVTGEVTIEAAKDNSKGITLTFPAKGNYKVAATKGLVKDAAGNESAAFTKEVKVVEKESEKETDKVAPAVTGVAFDKATNKITVNFDKEVKGGQVAESASNVNNYTLAGAKLPEGALIVLDGTNAVIELPSTFTFEKSETVKFTVANVANKDGVKMGTKNLLLNVVDTKAPEFQSAKITKVDAKEITLTFSEAVNVDATDFVIDLNGVALTVAKADDKAAKEVVLKVTAPTDVNLATGTLTLKTKELKDNATLNTVDTAANKLVAFKPVTVAR

SEQ ID NO: 71 - DNA, 3522 bp, Bacillus thuringiensis
atgaacgaaaccgtcgaggacgacgagaaaaaacgagcctggcttgataccgaaaaggttcagaccactgtcgctcaggtcacgaaactggcagacggatcactcaaggaactgggcgacggagcgcagttttccgaggtgttctgggcggatgcggtcgaaacatcgctttaccagacacaccccagagtgccggagctgcaaactcaaatggtgtgccggtacaagttcgaatcaggccgcatctatgtgaagaccttgcgctaccacatgaccacaaggggcgccaataaagatagggcaaacatagatttgggcctgcaggccggtacatgggtgcgcaagaactcacctgacagcatgctgcaagataaccggtggcacgattatgtggaatatgtcgactccccgctcggtcctcctgattttggcgtgtcgctggcaatccgggttaactacgacggagaaaacaacgatgttgaaccccacgaagggtggggccttgatatttatccagcacagaaaccgattatcgaggttcccacttccggaacctcgatcgatgtcgagaagccgttcactgtatccggtagaaacgggcttgtccccggcacaattcatttgaggcggcagtctaacaatgctgaaattccagtggggactgctcctgtccagaacaacggggggtggaatacctccatcgtgttgccgcccggcgttttggatttctacgccgtacaaatcattggcaaccagaactccggtaagtccaataccgttaccctcaaaaggtacgtggcaccacgtatcgactctccggcaaacagtgcggtactcaagtcggccagcggattgctgatcaaaggccgaggcacgccaggcaatgtcatcgatgtgatgaccccggggggcgccgtgttacacgccacgacaaccgtcaagcctgacgaaacgtgggaagcatcattcaaccagtccaactaccctgacggcggtcgcgtcgatatcacggctggccacagaggcatggatgattggaccgctgcgcaattcttcaccttgcttctgcagccgacaatcacgacgccatccgaatcagcggtgaccgatccgagaggtccgatagaaggggggagggctgttccaggtgcgaccgtcgaagtcctcaaggatttcgaacattcattcaaggtcggccagggcattgctgatgccaacggaggatggagggttacaacgttcacccgcgacatgccgccgggccgctttacggttgtggcgcagcaaacggtacctggcggcacttcggaagtgagtgtggcccgttcgttcaaagtccgccccccaacaccgagcacaatcaacttcacctacccgtccctcacctccatcgagttttccggcgcaggttttaccggcgccacggtcgagatcacgattgtccgcggtccgactggagctacgccgccacctgccgttgtcgtgaccgcaggcagttggagaacgacttcacagtactggcccatcggcgactacgatctgaaggtcgtgcagaaggttgacgacaatgctggtggctggattccctcgcatgaataccatttcaaggcctcatcaaagctaccaccgccctctgctgtgagatacaccaatgacctctacactccgacattcatcggcgaaggtatcgcaggggcatctgtcgaggtcaccgacaaggcgaccggcgctgcgctcgctccatcgacgcaggtcacgaatcagggctggttgacccgtgccttcgaggcgtgggcaccgggttcgacccgcaccgtgcgtgtggtgcagaggctcggtgcggcggtgtcggacgctgttgagctggtcatcaatatcgaccgtttcccaccgccgaccgagctggcttttaccgttgtcgactacaagccgcgtatcactggcagagggatagccggcgccacagtgcaagtgacggacaagcagaacggcgccgccattgcaccacccgcgcccgtgacgggccagggctggacggcagaggcatcgacaccctggcagccgaataccagcagaatcgtcctggtggtgcagtccaaagacgctttcgcctccgatccggtggaaataaccatctctgtgccgctgctggcacccatcatcactgccgtcgaagacgatggactctcgccgaaaatctccggctcctgctggcccggcgcgacactgagcctgaagtacagcgacagtgcgaccgagcacaaacctgatggaagcagtggcacatggaccttcaagcgcgacgccgggtttgctccggacgagcagcacaccgtgacggtgatccagaccgtcgccgggcgaccgtcgccgccagcctcgcaaacgttctcggtcagcccggagaaaccggatatcaccgcgccgaatgaaaacgcagacacccactacgacatgaacgtgcacggcatcaacggctataacggtgccacattgcaactgcgggacgcgcaattcgggcggaatctgggtgagccgaaacggctgaccgctcatggcgactggttcatcgagctgaaaaaactggagttccgcaaataccagatcgatgccgtgcaaaccatcgccggcagaccctctctgcccagtgctgtgcgcagtttttttgtcgtgctggtgccgccggtcatcacggtgccgcaggagcatcaatcgctggcgcgcacctcgacgcttcgtggcaccggcgaaccccttggccacgtgacgatctggcgtgaaagtccgagcgaaatcctgctcgataaaatctcgataggcgccaagggcgattggtttgccgacgtaacgttgccggtcggcaactacaaagtgaaggcccggcaattcttcgacgatcatgagtcgaaggaaagtcttgtgcgcagtttcaaggtggtgcccgccgcgccggttatcgaaagccccgggcgaggtgtgcacgtcggtcgtcgggttgttgtgtccggcttcggctaccccggtgacacagtgctggtgacgctgacgggcagcaagggttcggtacgcgtaagcgctccggtgctggaggatcgtacctggtcgctgacgcttgaaacggagcagtccgacggcactgcgcaactggtggcggtgtcctcgtgtgatggcttcgagtctgccccctcggctccacatccagtagagctgggcacttacctgcccgctatcgatgagccgacgccgggaagctggaaagaaaatccgcttcgcttcctcggtaaaggccgcacgggcgtggggcgcgtggtgagctggttcgaccctgatcaagtcttgagcgaagacattgccgtcaccgatcaaggctggcgcggcgaggcatcgcacgccttgcgtccaggcggccactggtgccgattccaacagaccgtcaccgacgctgcggatggctcgaccaagtccgactgggttgaaagcgagcgtttcgaggtgatttcgattccaccgggagcaagacca

SEQ ID NO: 72 - protein, 1174 aa, Bacillus thuringiensis
MNETVEDDEKKRAWLDTEKVQTTVAQVTKLADGSLKELGDGAQFSEVFWADAVETSLYQTHPRVPELQTQMVCRYKFESGRIYVKTLRYHMTTRGANKDRANIDLGLQAGTWVRKNSPDSMLQDNRWHDYVEYVDSPLGPPDFGVSLAIRVNYDGENNDVEPHEGWGLDIYPAQKPIIEVPTSGTSIDVEKPFTVSGRNGLVPGTIHLRRQSNNAEIPVGTAPVQNNGGWNTSIVLPPGVLDFYAVQIIGNQNSGKSNTVTLKRYVAPRIDSPANSAVLKSASGLLIKGRGTPGNVIDVMTPGGAVLHATTTVKPDETWEASFNQSNYPDGGRVDITAGHRGMDDWTAAQFFTLLLQPTITTPSESAVTDPRGPIEGGRAVPGATVEVLKDFEHSFKVGQGIADANGGWRVTTFTRDMPPGRFTVVAQQTVPGGTSEVSVARSFKVRPPTPSTINFTYPSLTSIEFSGAGFTGATVEITIVRGPTGATPPPAVVVTAGSWRTTSQYWPIGDYDLKVVQKVDDNAGGWIPSHEYHFKASSKLPPPSAVRYTNDLYTPTFIGEGIAGASVEVTDKATGAALAPSTQVTNQGWLTRAFEAWAPGSTRTVRVVQRLGAAVSDAVELVINIDRFPPPTELAFTVVDYKPRITGRGIAGATVQVTDKQNGAAIAPPAPVTGQGWTAEASTPWQPNTSRIVLVVQSKDAFASDPVEITISVPLLAPIITAVEDDGLSPKISGSCWPGATLSLKYSDSATEHKPDGSSGTWTFKRDAGFAPDEQHTVTVIQTVAGRPSPPASQTFSVSPEKPDITAPNENADTHYDMNVHGINGYNGATLQLRDAQFGRNLGEPKRLTAHGDWFIELKKLEFRKYQIDAVQTIAGRPSLPSAVRSFFVVLVPPVITVPQEHQSLARTSTLRGTGEPLGHVTIWRESPSEILLDKISIGAKGDWFADVTLPVGNYKVKARQFFDDHESKESLVRSFKVVPAAPVIESPGRGVHVGRRVVVSGFGYPGDTVLVTLTGSKGSVRVSAPVLEDRTWSLTLETEQSDGTAQLVAVSSCDGFESAPSAPHPVELGTYLPAIDEPTPGSWKENPLRFLGKGRTGVGRVVSWFDPDQVLSEDIAVTDQGWRGEASHALRPGGHWCRFQQTVTDAADGSTKSDWVESERFEVISIPPGARP

SEQ ID NO: 73 - DNA, 2100 bp, Bacillus thuringiensis
atgaatggaggagagaatatgaatcaaaataatcaaaatgaactgcaaataatagattcttcatccaatgattttagtcaatcaagcaggtatccaagatatccattagctaaagagtcaaattataaagattggctagctagttgtgatgaatccaatgtagatacattatcagctacaagtgatgtaaaggattcagtctccagggttttgggtattgtgaatcagattttggattttctaggtcttggatttattggaacaggtcttggtgtactaggtgatttatttaattcattttggccatcaaataataatgcggtttgggaggcttttctacgtagtgttgaagaacttattaatgaacgagtaagggaaactgagaggtcccgtatcgtagcccaatttacgggcctaagaagtgttctgttgaattataatggtgctcttcaggattgggataaagatcgtaataatcccgaacttagagatgaaataagaagccgctttgctaatgcagatgatatttttgcaaatcgtatggatgaatttagcataaaagggtttgaagtacaatcgctagctgtatatgcacaggctgcaactcttcatttattattattaagggatggggttcttaatggactgcaatggggattcaatatcgctacggttaaccgtctttataacagattggtagaaaagagtggtaaatatacagatcattgtacatccttttataggcagggtttgcaggagttaaggaacagagggaattggaatgcattcaatacttatcgcagaaacatgactattcaagtattggatgtcatttctttattttcaaattatgatcctcgcctatatgaaattaatacaaacacacaacttacaagagaaatatacactgaaccacttgctggtcctggatggcttaattctcattccaatccaactcaattccaacaaatagaaaatgatcttattcgctcaccttcagtattttctaatctacagattctttttatggaagctggttttgcattccacgatatccagacacctagacaaacagtattaagaacacttacgcagagtttgaatacggggcgtactggtatcatcgtaactccttggcaaggtgcacttaatcctagtgtttcacaacgactgcaggtgcaatttgaaaataggaatgtttttaatatcaattcagtagtagcttggcaaacttctaatccaaacagctcattatttggggtccaacaagccatttttaactttgtgtacgaaggcggaaacgcagcttcgacaacacaattcaatctaccaagtgctagatatttaacgtctataacgtctaatataccaggaacaaactcaacaactccaaccggttcagattatacccatagactatcttcgataacttcaacttcagtaggaacgtggcagagagatagaacgaatattatggcatatggatggactcatgttagtgcagagcgtactaataggattataccgaatagaattacacaaattccagctgtaaaaggatcactgtctagtgataatccaccaaaccaattacgaacacgtgtagaaagtggccctggtcatactgggggaggactcgtagttatgggcggaggaactagtgtattacagatgagaatcacttcttcagcaaggcaaaggtatgatatgcgtttacgttatctagctcttgctccagctgctgttgaagtaagaattccggaattaggggagcatgttaggtttcagatgccaatgactgcaacggggttgactgcgcctctaccatactgccatttgcgatatgtggatatcccgctgaggtttgagacacccaatggtgaaaatacttggacgtttgaactacggactatgaatgcagcagttgcaattgacagggtcgaattcataccagttaatgctacagctttagaatatgaaggaaaacgacatctagaaaaagcaaagaaagccgtgggtgatctgtttatcaataatggaaaagaggctttaaaagtagatacgacggattatgatgtggatcaagctgcaaatctagta

SEQ ID NO: 74 - protein, 700 aa, Bacillus thuringiensis
MNGGENMNQNNQNELQIIDSSSNDFSQSSRYPRYPLAKESNYKDWLASCDESNVDTLSATSDVKDSVSRVLGIVNQILDFLGLGFIGTGLGVLGDLFNSFWPSNNNAVWEAFLRSVEELINERVRETERSRIVAQFTGLRSVLLNYNGALQDWDKDRNNPELRDEIRSRFANADDIFANRMDEFSIKGFEVQSLAVYAQAATLHLLLLRDGVLNGLQWGFNIATVNRLYNRLVEKSGKYTDHCTSFYRQGLQELRNRGNWNAFNTYRRNMTIQVLDVISLFSNYDPRLYEINTNTQLTREIYTEPLAGPGWLNSHSNPTQFQQIENDLIRSPSVFSNLQILFMEAGFAFHDIQTPRQTVLRTLTQSLNTGRTGIIVTPWQGALNPSVSQRLQVQFENRNVFNINSVVAWQTSNPNSSLFGVQQAIFNFVYEGGNAASTTQFNLPSARYLTSITSNIPGTNSTTPTGSDYTHRLSSITSTSVGTWQRDRTNIMAYGWTHVSAERTNRIIPNRITQIPAVKGSLSSDNPPNQLRTRVESGPGHTGGGLVVMGGGTSVLQMRITSSARQRYDMRLRYLALAPAAVEVRIPELGEHVRFQMPMTATGLTAPLPYCHLRYVDIPLRFETPNGENTWTFELRTMNAAVAIDRVEFIPVNATALEYEGKRHLEKAKKAVGDLFINNGKEALKVDTTDYDVDQAANLV

SEQ ID NO: 75 - DNA, 1977 bp, Bacillus thuringiensis
atgaattcatatgaaaataaaaatgaatatgaaatattggaatcttcatcaaataacacaaatatgccaaacagatatccttttgcaaatgatccaaatatttttcctattatcctgaacgattgtccgggaaaaccatggcaagatacgtggaaatcaatctcgaatttcataagtgttatggtaagcatggcaggattcataagctcacctggtctactaattggaattcctgcactattgggaatagtaaacctactaattccatcttctggtccatctgtggcagcactttctatatgtgatttattatctataattcgtaaagaggtagacgagagtgttttaaatgacgcggttgcagattttaacggtaaattgactaattataaagagtattatctttcttctcttcaggagtggcttagtgcaggtaaaccaaatgatagcagacttagtaatgtagttgagtatttcaaaaagtctgaagaaggtttcaatgaaattctagcagggtcattatcaaggcagaatgctcaaatattattattgcctacgtttacgcaagctgcaaatgtacagttattactattaagggatgcagttcaatataaaaaagaatggggagcattgttgagtgcggagaaagtaggatcggaattaatatcacctactattgattatggtcagcgattaaaagataaaatagcacagtataccaagtattgtgtattttggtatcaggagggtttaaatcagataaaagaggggggggcatatgctgaaacttggttgaaatttaataaatttcgtagagaaatgacgttagcggtattggatattatcgctctatttccaatttatgattttgcaaaatatccattaggaacaaatgtagagttaactagggaaatttatacagacccagtgggatattcagggggaaattatcgttgggaagggctttttagctttaattcgctagaagctaatggaacacggggacctggtttagttacttggcttcaagctatagatatatatagtcattctgttaatattctacctggttatagttatcttaccggctggggaggaactcgtcattatgaagactacacaaagggtaacggtgcttttcaacgtatgtctggaactacgagtaatgatccacatcctattagtttcggcactaccgatatatttaaaattagttcattagctagagttgaattgcaaccatttgttgggtattcaatcccacggtatcgtacttcacgtgcagaattttttccgacaacactaaatactttactatatgagagaaacagttctgggtactcacagacaattgaatctgtgttaccaggtattgataaggatcgatcacctagtcctacaaattactctcatagattatcaaatgcggcatgtgttcaatatgaaacctccgtagttaacgtatttggttggacacatacaagtatgacaagaaataatccaatttatccagataaaattacacaaataccggctgtgaaagcatttgctttagaaaacgacgcttatgttagcgctggacctggtgatacaggaggagatgtagtaacgttaggatatcttggacgtttaaaaatacgtttaactcctgcagccacaaataaagactaccttgttagaattcgctataaaagtgcatcaaatggtcggataaacgtacaaagatggtcgccgagttctactataggtaattattattatgttccaaatacaggtcctggtgattcatttggctatttggaaaccttagttactacatttcatcagccaggtgttgaaataattatacagaatcatgatgtctctattatcattgacaaagttgaatttatcccacaggattctacggctttagaatatgaaggaaaacaaagtctagaaaaggcacaaaatgtagtgaatgatttatttatcaat

SEQ ID NO: 76 - protein, 659 aa, Bacillus thuringiensis
MNSYENKNEYEILESSSNNTNMPNRYPFANDPNIFPIILNDCPGKPWQDTWKSISNFISVMVSMAGFISSPGLLIGIPALLGIVNLLIPSSGPSVAALSICDLLSIIRKEVDESVLNDAVADFNGKLTNYKEYYLSSLQEWLSAGKPNDSRLSNVVEYFKKSEEGFNEILAGSLSRQNAQILLLPTFTQAANVQLLLLRDAVQYKKEWGALLSAEKVGSELISPTIDYGQRLKDKIAQYTKYCVFWYQEGLNQIKEGGAYAETWLKFNKFRREMTLAVLDIIALFPIYDFAKYPLGTNVELTREIYTDPVGYSGGNYRWEGLFSFNSLEANGTRGPGLVTWLQAIDIYSHSVNILPGYSYLTGWGGTRHYEDYTKGNGAFQRMSGTTSNDPHPISFGTTDIFKISSLARVELQPFVGYSIPRYRTSRAEFFPTTLNTLLYERNSSGYSQTIESVLPGIDKDRSPSPTNYSHRLSNAACVQYETSVVNVFGWTHTSMTRNNPIYPDKITQIPAVKAFALENDAYVSAGPGDTGGDVVTLGYLGRLKIRLTPAATNKDYLVRIRYKSASNGRINVQRWSPSSTIGNYYYVPNTGPGDSFGYLETLVTTFHQPGVEIIIQNHDVSIIIDKVEFIPQDSTALEYEGKQSLEKAQNVVNDLFIN

SEQ ID NO: 77 - DNA, 1962 bp, Bacillus thuringiensis
atgaattcttatcaaaatacaaatgaatatgaaattctggatggttccccgaataacacaaatatgtcaaacagatatccttttgcaaaagatccaaatatatttcctattaacctggacgcttgtcagggaaggccatggcaagatacgtgggaatcagtctcggatatagtaactattgggacataccttatacaattcttgctagaacccggtataggtggaattcctgtaatattgtcaataataaacaaactcattccgtcttctggtcaatctgtggcagcactttctatatgtgatttattatctataattcgtaaagaggtagacgagagcgtgttaagtgacggggttgcagattttaagggtgaaatgactgcttatcgagattattatcttccttatcttgaggattggcttacagataaatcaaatcctgaaaaacttgctgacgtagttaaacagttccaagcacgggaagaagatttcactaaacttttagcagggtcattatcaagacagaaagctgaaatattattattgcctacgtatgtgcaagctgcaaatgtgcatttattactattaagggacgcagttaaatataaaaaagaatggggactagtgtgtccaccgttgtatccagggtcagggagaactgattgtaacgagcggttaaaagcgaaaataaaagagtatactaattattgtgtagagtggtataacaagggtttagatcagataaaacaggcgggtacaagtactgaaacctggttgaaatttaataaatttcgtagagaaatgactttggcggtattggatgttattgctatatttccaacttatgattttgaaaaatatccattagcaacaaatgtagaattaactagggaagtttatacagatccagtggggtattcaggaagcagtattcgttgggaaaggacttttcccaatgcttttaatacgctagaagctaatggaacacggggacctggtttagttacttggcttgaagttttaggtatatataatcatgattttcaggatattacggtttattttagcggctgggtaggaagtcgtcattctgaagactacacacggggtaacggtactttttcacgtatatctggaactacgagtaatgatatacgcaatcagactttttactctcgcgatgtatttaaaattgattcattaggtatctatgaaacaagagcagagcttggatacacacggcaacggttttgtgtttcacgtgcagtatttagttcaacactatataactacgtgtatgatgcaagaaataatgggcaaggccgaatgacaattgaatctatgttaccaggtattaagaatccaatacctagttctcaagattactctcatagattatcaaatgcggcatgtgttcaatttaacgactccagaattaacgtatatggttggacacatacaagtatgacaaaaaacaatccaatttatacagataaaatttcacaaataccggcggtgaaagcatttgctttagaatcaggcgcttatgttagccgtggacctggtcatacaggaggagatgtagtaacgttaccaaatagagggcgtttaaaaatacgtttaacttctgcacccacgaataaaaattaccgtgttagagttcgctatgcaacttcttatggagctgatttaatggtacaaaggtggtcgccgagtggcaatcatgcaagtggttattttagtggttcacctacgggttcttatcctacatttggatatatgaatactttagttactacatttaatcaatcaggtgttgaaataattatagaaaatcgacattatagcaacattatcattgacaaaatcgaatttatcccagatgatataacaactttagaatatgagggagaacgggatctagaaaaaacaaaaaacgcggtgaacgatttgtttaccaat

SEQ ID NO: 78 - protein, 654 aa, Bacillus thuringiensis
MNSYQNTNEYEILDGSPNNTNMSNRYPFAKDPNIFPINLDACQGRPWQDTWESVSDIVTIGTYLIQFLLEPGIGGIPVILSIINKLIPSSGQSVAALSICDLLSIIRKEVDESVLSDGVADFKGEMTAYRDYYLPYLEDWLTDKSNPEKLADVVKQFQAREEDFTKLLAGSLSRQKAEILLLPTYVQAANVHLLLLRDAVKYKKEWGLVCPPLYPGSGRTDCNERLKAKIKEYTNYCVEWYNKGLDQIKQAGTSTETWLKFNKFRREMTLAVLDVIAIFPTYDFEKYPLATNVELTREVYTDPVGYSGSSIRWERTFPNAFNTLEANGTRGPGLVTWLEVLGIYNHDFQDITVYFSGWVGSRHSEDYTRGNGTFSRISGTTSNDIRNQTFYSRDVFKIDSLGIYETRAELGYTRQRFCVSRAVFSSTLYNYVYDARNNGQGRMTIESMLPGIKNPIPSSQDYSHRLSNAACVQFNDSRINVYGWTHTSMTKNNPIYTDKISQIPAVKAFALESGAYVSRGPGHTGGDVVTLPNRGRLKIRLTSAPTNKNYRVRVRYATSYGADLMVQRWSPSGNHASGYFSGSPTGSYPTFGYMNTLVTTFNQSGVEIIIENRHYSNIIIDKIEFIPDDITTLEYEGERDLEKTKNAVNDLFTN

SEQ ID NO: 79 - DNA, 1665 bp, Bacillus thuringiensis
atgggaggaacaaatatgaatcattttcaaaacgttattccagaacttgtaaactcttgtcctcctgatgattgcgattactataacatcctagtattatctagttatgcacaagtagcaaacttacatctgactgtattaaatcaagccgtcaaatttgaagcgtatttaaaaaataatcgacaattcgattatttagagcctctgccaacagcaattgattattatccagtattgactaaagctatagaagattacactaatcattgtgtaacaacttataaaaaaggattaaatttaattaaaacgacgcctgatagtaatcttaatggaaatataaactggaacacatataatacatatcgaacaaaaatgactacttccgtattagatcttgttgcactgtttcctaattttgatgtaggtaaatacccaataggtgtccaatcggaacttactagagaaatttatcaggtacttaacttcgaagaaagcccctataaatattatgactttcaatatcaagaggattcacttacacgtagaccgcatttatttacttggcttgattctttgaatttttatgaaaaagcgcaaactactcctaataattttttcaccagccattataatatgtttcattacacacttgataataaatcccaaaaatctagtgtttttggaaatcaaaatgtaactgatagattaaaatctcttgatttggcaacaaatatttatatttttttattaaatgtaacaagtttagataataaatatctaaatgattataataatattagtaaaatggatttttttataactaatggtactagacttttggagaaagaccttacagcaggatctggacaaataaattctgatgtaaataaaaatattttcggtttaccaattcttaaacgaagagagaatcaaggaatccctaccctttttccaacatatgataactatagtcatattttatcatttattaaaagtctcagtatccctgccacatataaaactcaagtgtatacgtttgcttggacacactctagtgttgatcctaaaaatacaatttatacacatttaactacccaaattccagctgtaaaagcaactttacttgggactgccactactgaactttctaaggttgttcaagggcctggtcatacaggaggggatttaattgattttaaagatcgtttcaaaattatatgtcaacattcaaattctcaacaatcgtactttgtaagaattcgttatgcttcaaatggaagcgcaaatactcgtgctgctataaatcttagcatcccaggggtagcagaacttgatatggcactcaacccaactttttctggcacagattatacgaatttaaaatataaagattttcagtacttagaatttttggatgaggtgaaatttggtccaaatcaaaacctttctcttgtgtttaatcgtttggatgtatatacaaacacaactgtacttattgataaaattgaatttctgccaattactcgttctataagagaggacagagagaaacaaaagttagaaacagtacaacaaataataaatacattttttgtaaattctataaaaaacactttaaaatcagaaattacagattacgatattgatcaagcagctaaattagta

SEQ ID NO: 80 - protein, 555 aa, Bacillus thuringiensis
MGGTNMNHFQNVIPELVNSCPPDDCDYYNILVLSSYAQVANLHLTVLNQAVKFEAYLKNNRQFDYLEPLPTAIDYYPVLTKAIEDYTNHCVTTYKKGLNLIKTTPDSNLNGNINWNTYNTYRTKMTTSVLDLVALFPNFDVGKYPIGVQSELTREIYQVLNFEESPYKYYDFQYQEDSLTRRPHLFTWLDSLNFYEKAQTTPNNFFTSHYNMFHYTLDNKSQKSSVFGNQNVTDRLKSLDLATNIYIFLLNVTSLDNKYLNDYNNISKMDFFITNGTRLLEKDLTAGSGQINSDVNKNIFGLPILKRRENQGIPTLFPTYDNYSHILSFIKSLSIPATYKTQVYTFAWTHSSVDPKNTIYTHLTTQIPAVKATLLGTATTELSKVVQGPGHTGGDLIDFKDRFKIICQHSNSQQSYFVRIRYASNGSANTRAAINLSIPGVAELDMALNPTFSGTDYTNLKYKDFQYLEFLDEVKFGPNQNLSLVFNRLDVYTNTTVLIDKIEFLPITRSIREDREKQKLETVQQIINTFFVNSIKNTLKSEITDYDIDQAAKLV

SEQ ID NO: 81 - DNA, 2484 bp, Bacillus thuringiensis
atgacaactttatctgatttatattcccctataccttataacgttatggtaactccgccattaaaagaaggaaaatattgggatcaatttaaagcgttaataaaagaactaaaaggcggatggaacgaattcgaaaaaactggatatagcaaaccttatctatctgctattgatgaggcccttaaaatatataaaggtggagacgtagattataccgctttagttaaatcattcttatctattggatcaactcttggtgaattcattccaggtggtactattattgttcccatttttaatgggttagtggatcttatttttccgcacttatttggatcaaaagaggcggacaacaacacaaaattctttaatatgataatcgcagaagtagctaaaatgatagataaaagcatccaagatcttgtcatagagttagacactaacacgattaatggaatcggtgaagctgcaaaacttcttcaaactgaaatacaaactgccataggagcaccggctgcagtgtttggtccaaagttagatgcagcagccctacaactagattcttgctccacttcaccttgtaaaacacctaccgtagacgctttaaagaaggttgaaaaccaatttatagcttccactaccactatcgctacaaacataccatcacttcttctgaagaccggatctgaccgtaatgcacagcgtcaaacggttatgttaacgttaccgatgtatgtaacaggtgcaacattacatttatctctcatacaagggtatattcaatttatgcaacaatggaaagatgtgtatgccgccaatctaagcagtgctatatctaccttgcagagatatattcagcaatattccaacaccgtattaaatatgtataatgactataacaaagacgtaattcctgggataaataacaaagacatattaaataaatatatccaatacaatcgagtgatggcgacacaagtatttgatatggtctccatgtggtcttctttctttccagcagactacccttcaacatttaacacagaccaaactcgtatcgcatttggaaatatcgctggaccaacagaagaccaacctacccttcattttgatctctatgatgtttacagtaagaaattaccaaataatgatatttttaattatttttataatgggatgcaattaaacacatttgaacttgctggggctcatagtgcagattataatcgtgtgtatactacagggataaatgcaaggtacaacacttataatacaaccaatagcattgcacaatatgcttatacaggtccttatattaagaatttttccgaacaagacgtattgaacttaactaatattaatatactctctgtaaaaactaaatatcaagatattaataaattaatttataattgtcaaagctataatcctgaggcttcccgtggttatcaacttaacggctgtgattatagtgctggatacacaccacaagtccagcctaaaaatgtatacgtatcagccaacgtaccgtttagtaatcaaaaaattcaagcgatttatccagttgccagtactgatgtttggggaggtaaagacaaacgtggttatctttatacacttgtcgattatgatttatttcctcaaaatgttatagggcaacccaatgaagatggacttattagccaaatgattcaagggttccctgcagaaaaaggttttataagtaataatataggtactttacaactggttcctgaaccaattaatagtgccgcagctgtcaacttaaaattccaacaaatattatcattaccaattactaatctaaccgttcaaaactatcaaattcgtgttcgatatgcaaataaatcagacaatacaatttatttccgtgttgaaacacctaatggaaatctaaacagtggtccacaaacgcttaaaaatgcgcaagatactacaaatataactattaaaggtaataacggagactacactttacaaacattggcagataaagtttttcttccttccggaaatttaaccgtacattttcaaaataatagtaattcagatctctttttagatcggattgaatttgttccactacctctaaaacaagaagttctaaaacctacagatattaatattttcaaaggaagtcctgatccaattgtttgggaatcacaagataaagaagcagttagtgctgttttaaatgtaagagaggaatttggaatgcctgttactaattttgtattcgacttttatttaaataatgtacttcaattttcagaagatataattggtggagaaaaaacttatatgcataatgggaaaaccttcaataaaattacaggtagaaataccaatccagtagtgataagtgatacgttaattatatcaggaatcattaatgaagaatattctcgaagttcaaatatttttgaaaccccagaagatttagaattgatcacaaaccaagtg

SEQ ID NO: 82 - protein, 828 aa, Bacillus thuringiensis
MTTLSDLYSPIPYNVMVTPPLKEGKYWDQFKALIKELKGGWNEFEKTGYSKPYLSAIDEALKIYKGGDVDYTALVKSFLSIGSTLGEFIPGGTIIVPIFNGLVDLIFPHLFGSKEADNNTKFFNMIIAEVAKMIDKSIQDLVIELDTNTINGIGEAAKLLQTEIQTAIGAPAAVFGPKLDAAALQLDSCSTSPCKTPTVDALKKVENQFIASTTTIATNIPSLLLKTGSDRNAQRQTVMLTLPMYVTGATLHLSLIQGYIQFMQQWKDVYAANLSSAISTLQRYIQQYSNTVLNMYNDYNKDVIPGINNKDILNKYIQYNRVMATQVFDMVSMWSSFFPADYPSTFNTDQTRIAFGNIAGPTEDQPTLHFDLYDVYSKKLPNNDIFNYFYNGMQLNTFELAGAHSADYNRVYTTGINARYNTYNTTNSIAQYAYTGPYIKNFSEQDVLNLTNINILSVKTKYQDINKLIYNCQSYNPEASRGYQLNGCDYSAGYTPQVQPKNVYVSANVPFSNQKIQAIYPVASTDVWGGKDKRGYLYTLVDYDLFPQNVIGQPNEDGLISQMIQGFPAEKGFISNNIGTLQLVPEPINSAAAVNLKFQQILSLPITNLTVQNYQIRVRYANKSDNTIYFRVETPNGNLNSGPQTLKNAQDTTNITIKGNNGDYTLQTLADKVFLPSGNLTVHFQNNSNSDLFLDRIEFVPLPLKQEVLKPTDINIFKGSPDPIVWESQDKEAVSAVLNVREEFGMPVTNFVFDFYLNNVLQFSEDIIGGEKTYMHNGKTFNKITGRNTNPVVISDTLIISGIINEEYSRSSNIFETPEDLELITNQV

SEQ ID NO: 83 - DNA, 1947 bp, Bacillus thuringiensis
atgaaaccaaataaccaggataatcatgaaaccttatccaacaaagtgacagtcgaaaaaccttttacagattcactaaaaaatgaaacaactaaaaatagtaattatgaagattgtttgaaaatgtctagacatgaaagcgtagagccgtttgttagtgtatcaacaattcaaacgggaattggtattgctggtaaaatccttggtagcctaggcgttccttttgctgggcaagtagctagcctttatagttttattctaggtgagctttggcctaaggggaaaagtcaatgggaaatctttatggaagatgtagaaaaacttgttgatcaaaaaatatcgatttacgcaagaaacaaagcacttgcagatttaaaaggattaggagatgctctggctgtctaccatgaatcccttgaaagttggattgaaaatcgtaataacagaagagctagaagtgttgttaaagaccaatatatcgctttggaacttatgtttgttcagagacttccttcttttgcagtatctggagaagaggtgccgctattaccaatttatgctcaagctgcaaatttacacttattgctattaagagatgcatcaatttttggagaagaatggggtttttcaacttcagaaatttcaacattttataaccgccaatctagtcggacgatagaatattctgactattgctcaggatggtataatacaggactaaatcgcttgagaggtgcaaatgctgaaagttgggtacgatataatcaattccgtagagacatgactttaatggtactagatctagtagcactattcccaagctatgacactcgcacttatccaattaaaactagtgcccaacttacaagagaagtctatacagatccaaacggtattgtagcaggaggcaataataattggtttagaaatggggcttcgttttccactatagaaaacgcaattattcgacaacctcacctatatgattttctaacgaaccttacaatttacacgagaataagtcgagcaaaccctgcttatatgaatttgtgggcagggcatagaattacttctaatagaataggttctagtaatagtagtgaattggtgtatggggctataactaatccagttagtactactaacttatcatttgtcaatcgggatgtttaccgaactgaatcattagctggtgggcttggcactctgaatggaatactttatggtttaactagagttgattttgatatgatatttcgtaaccgtcctgatatagtaactggattattttatcatccgggacacgcgggcattgcaacccaagtaaaagattcagaaacagaattaccacctgaaacgacagaacagccaaattatagagcatttagtcatctactaagtcatatttcaatgggtccaacgactcaagacgtacctccagtatattcttggacacaccagagtgcagaccgttcaaatacaatcgattcggataggataacacaaataccattggtaaaggcgcatacccttcaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactgacttaagaatttacgtaacggttgcaggcgaacgaatttatgctggtaaatttaataaaaccatgaaaaaaggtgacccattaacattccaatcatttagttacgcaactattaatacagcttttacattcccagaaagatcgagcagcttgactgtaggtgctgatacgttcgattcaggtaatgaagtttatgtagatagatttgaattaatcccggatactgtaacatttgaggcagagtctgatttagaaaaagcg

SEQ ID NO: 84 - protein, 649 aa, Bacillus thuringiensis
MKPNNQDNHETLSNKVTVEKPFTDSLKNETTKNSNYEDCLKMSRHESVEPFVSVSTIQTGIGIAGKILGSLGVPFAGQVASLYSFILGELWPKGKSQWEIFMEDVEKLVDQKISIYARNKALADLKGLGDALAVYHESLESWIENRNNRRARSVVKDQYIALELMFVQRLPSFAVSGEEVPLLPIYAQAANLHLLLLRDASIFGEEWGFSTSEISTFYNRQSSRTIEYSDYCSGWYNTGLNRLRGANAESWVRYNQFRRDMTLMVLDLVALFPSYDTRTYPIKTSAQLTREVYTDPNGIVAGGNNNWFRNGASFSTIENAIIRQPHLYDFLTNLTIYTRISRANPAYMNLWAGHRITSNRIGSSNSSELVYGAITNPVSTTNLSFVNRDVYRTESLAGGLGTLNGILYGLTRVDFDMIFRNRPDIVTGLFYHPGHAGIATQVKDSETELPPETTEQPNYRAFSHLLSHISMGPTTQDVPPVYSWTHQSADRSNTIDSDRITQIPLVKAHTLQSGTTVVKGPGFTGGDILRRTSGGPFAFSNVNLDFNLSQRYRARIRYASTTDLRIYVTVAGERIYAGKFNKTMKKGDPLTFQSFSYATINTAFTFPERSSSLTVGADTFDSGNEVYVDRFELIPDTVTFEAESDLEKA

SEQ ID NO: 85 - DNA, 2130 bp, Bacillus thuringiensis
atgaattcaaataatcaaaatgaatataatgcttcatctactacttctgtatccaatgattctaacagataccctttagcgaatgggccaacaaatgcgttacaaaatatgaattataaagagtatttaagaatgtccgagggctatgatagagaatattctgcttcacctggagcacttgttagtgggaaagaagcaattaaggttggaatcgatattgtcggcaaaatattaggggggttagggattccatttgttcctcagatagttagtttttataattttattctcgatcagctatggccatcaaattctgtgagtgtatgggaacagattataacgctagtggaagaacttgtagatcaaaaaataacagaatatgcaagaaataaggcactcgctgaattaaaagggctaggagatgctttgaatgtatatcagcaatcacttgaagcatggttggaaaatcgcaatgacacaagagctagaagtgttgtttctaatcaatttgcagctttagatcttgattttgttggggcaattccatcctttgcagtatccgggcaggaagtaccattattagcagtatatgcacaggctgtgaacatgcacttattgttactaagagacgcttctatttttggagaagagtggggattcacatcatatgaaatttccacttactacaaccgtcaagtacaactcacttctcaatatactgattattgcgtaaagtggtacaatacaggtttagaaaaattaaaaggtacgcgcgctgagaattggttggagtatcatcaattccgcagagagatgactctcatggtattagatttggttgcattatttccaaactacaatacacacacgtatccacttgaaacaaaggctcaacttacacgagaagtatatacggacccgatcgcctttaatctttctggggcagcgggtttttgtagaccttggtcaaagtatactggtatttccttttcggagattgaaaatgctgtaattcgtccgcctcatttatttaatgtactcagaagtttagaaattaatacagttagggggacaattttaggtaatactaaagattacctaaactattggtcaggtcattctctacgatataattttataggtgatacaacagtaagggaaaataattatggatatcttacttcagaaaaaactaggattgaattagacactagagatatttttgaaattaattcaactgccgctagcttagcgaattactatcaagagacttatggtgtgccagaatcttggctccatatggtgcaatgggatagcccatattatacatcatcttatctttattctaaaacacatacaactggagaaggttgtacacaagtttatgaatcaagtgaggaaatacctgtagacggaacggtaccggtaaatgaaggttatagtcacagactatcttatgtcacctctctctttttccagaaaattattaatactttttatacaaatggaactctacctgtctttgtttggacacatcggagtgcggatttcaccaatacaatttatccggataaaatcacgcaacttccaatagtaaaaacatacactttaccttcaggtacttccgtaatacagggtcctggatttacaggaggaaatatattaaaaagaacaagcactggcagaataggaacttttcgaattaacttaaccggaccattgacacaaagatatcgtgtaagaattcgttatgcttcttctagtgatataaatttccgtgtaactcatgcgggtaagacggttaatgactatttctttagtaaaactatgaagcaaggagcatctttaacatatgaaacatttaaatttgctagctttactacgcctttcagatttgaaaatacttcaggtgaaatagggatagatgtgtataattttctctcaagtggagaagtttatgtagaccgaatcgaagtcatcccagtagatgcgacatatgaagcggaacaagatttagaggcggcaaagaaagcagtgaatgccttgtttacgaatacaaaagatggcttacgaccaggcgtaacggattatgaagtgaatcaggcggcaaacttagtggaatgcctatcg

SEQ ID NO: 86 - protein, 710 aa, Bacillus thuringiensis
MNSNNQNEYNASSTTSVSNDSNRYPLANGPTNALQNMNYKEYLRMSEGYDREYSASPGALVSGKEAIKVGIDIVGKILGGLGIPFVPQIVSFYNFILDQLWPSNSVSVWEQIITLVEELVDQKITEYARNKALAELKGLGDALNVYQQSLEAWLENRNDTRARSVVSNQFAALDLDFVGAIPSFAVSGQEVPLLAVYAQAVNMHLLLLRDASIFGEEWGFTSYEISTYYNRQVQLTSQYTDYCVKWYNTGLEKLKGTRAENWLEYHQFRREMTLMVLDLVALFPNYNTHTYPLETKAQLTREVYTDPIAFNLSGAAGFCRPWSKYTGISFSEIENAVIRPPHLFNVLRSLEINTVRGTILGNTKDYLNYWSGHSLRYNFIGDTTVRENNYGYLTSEKTRIELDTRDIFEINSTAASLANYYQETYGVPESWLHMVQWDSPYYTSSYLYSKTHTTGEGCTQVYESSEEIPVDGTVPVNEGYSHRLSYVTSLFFQKIINTFYTNGTLPVFVWTHRSADFTNTIYPDKITQLPIVKTYTLPSGTSVIQGPGFTGGNILKRTSTGRIGTFRINLTGPLTQRYRVRIRYASSSDINFRVTHAGKTVNDYFFSKTMKQGASLTYETFKFASFTTPFRFENTSGEIGIDVYNFLSSGEVYVDRIEVIPVDATYEAEQDLEAAKKAVNALFTNTKDGLRPGVTDYEVNQAANLVECLS

SEQ ID NO: 87 - DNA, 2268 bp, Bacillus thuringiensis
atgacaggaggaaaatccatgaaccaatacgatagaaatgatgaaatggaaattcttgatccaggaaggggccaggtcagatatccgtatgcatatgagccaaattcagagttacaatcgatacattacaaagattggctagatatgtgtgaaaggaatggcaacggtcccacagggttacgaacgggtacattggtatcgtcacaagatattattaatgttagcttagatattgttggtaacgttttaggacttatacctgtagtaggtggagctataaaagcaggagtttcaatacttaagtccatacttggtctactttggccaaagccagaagaaccaggaacagatccaaatgcaatatggatcgagtttatggaaaaggtagaagtactgattgatcaaaaaatttctcaagaagcatttaatgcagcaattggaaggttaaacggcttaaaacgagctttaaatttatatcaagtagcatttgaactttgggctggcgatcaagttgatgaagagctaaaagaggatgtacgaactcgctttacagcggccctctttgaaatggtggctacaatagagacgtttagatatgctggacaagaggtaaatctactcacagtgtttgcacaagctgcagatcttcacttgttgctattaagagaagggattatgtttggattacaatggggttttgatcaaagaacagtagattctttttatacaaattctcaaaaagaagggctaaaggatttacttcctatatacactgattattgtacctcttggtataatgaaggtttaaaaatcacctatacattgaagccagatttatcaaatactgaaagatatccatgggctgcagacaaaccttcatggaaccttcgagttcttgaagaattagaaggttggaatctatttaacgattggcgaagagatgtgacgattatggcattagatttggttgccttgtggccaacttatgacctatattattatgataatttgaagtatggtgtaaaaactgaacttacacgtccagtgtattctcaagcggctggaaccagctggggtagcatattaccacgggatcgctatgaacaaggtatagtccgttcaccacatttagtgacatggttacattcaattgattttcatttaaaccctggtccgttctctgtgagtaatagctataaacattatacgggtcttaaactgaaatattattattccggtcgagattacacagtatatgaatcgccactaataggtactacgtcttctagtgggaaaacaattaatgtggaagctaaatatgggactgctattttccaatcagatattaagcataacgatgcagtatatacaatggatttctttaaaaataacgggagtagtgacaaggttggatatctatatgagccaaactattctacactgtcatggccacctgagactggggtttccaattatggtcatcaaatgacgtggataagtggcccagtagaaagtggtacgataccggctttcggtgcagaatgggtacatgaaagttgctctccttttaatgctatagcagacgacacagtagaaaatcctatcattactcaaattccagcagtgaagggggcaagtatagcaggaaatgcaacggtgataaaaaatcctggtcatacaggtggtgatctcgtacaattacctgcgaattctggatcacaagctcaattgttaataagtatggaaactccttattcaaaggtaggaaaagcatatcaaatacgagttcgctatgcggctagttccaatgctaccttacaagtggatcaatgtgcttatcttggaggaagttgttataacagcgcatctattcctgttacagctacgtattctaataatgtattatcgtatagtgcatttcagtatgcagatgtgttcccgataacgatacaaagtgcggacttttccttacagtttttcaacagaagtggtggacctattatcctcgataaaatcgagtttattccaatagaaggttccttagaagagtatcaagcgaaacaagagttagagaatgcgagaaaggccgtgaatgccttatttacgaatgatacaaaaaacgcattgcgtttagaaatcacggattatgatgtggatcaggctgcaaataaagtcgcgtgtatgtctaatgatagatatggaaaagaaaaaatgatcttactcgatcttgtaaaatacgccaaacacttaagccaggaaagaaatgta

SEQ ID NO: 88 - protein, 756 aa, Bacillus thuringiensis
MTGGKSMNQYDRNDEMEILDPGRGQVRYPYAYEPNSELQSIHYKDWLDMCERNGNGPTGLRTGTLVSSQDIINVSLDIVGNVLGLIPVVGGAIKAGVSILKSILGLLWPKPEEPGTDPNAIWIEFMEKVEVLIDQKISQEAFNAAIGRLNGLKRALNLYQVAFELWAGDQVDEELKEDVRTRFTAALFEMVATIETFRYAGQEVNLLTVFAQAADLHLLLLREGIMFGLQWGFDQRTVDSFYTNSQKEGLKDLLPIYTDYCTSWYNEGLKITYTLKPDLSNTERYPWAADKPSWNLRVLEELEGWNLFNDWRRDVTIMALDLVALWPTYDLYYYDNLKYGVKTELTRPVYSQAAGTSWGSILPRDRYEQGIVRSPHLVTWLHSIDFHLNPGPFSVSNSYKHYTGLKLKYYYSGRDYTVYESPLIGTTSSSGKTINVEAKYGTAIFQSDIKHNDAVYTMDFFKNNGSSDKVGYLYEPNYSTLSWPPETGVSNYGHQMTWISGPVESGTIPAFGAEWVHESCSPFNAIADDTVENPIITQIPAVKGASIAGNATVIKNPGHTGGDLVQLPANSGSQAQLLISMETPYSKVGKAYQIRVRYAASSNATLQVDQCAYLGGSCYNSASIPVTATYSNNVLSYSAFQYADVFPITIQSADFSLQFFNRSGGPIILDKIEFIPIEGSLEEYQAKQELENARKAVNALFTNDTKNALRLEITDYDVDQAANKVACMSNDRYGKEKMILLDLVKYAKHLSQERNV

SEQ ID NO: 89 - DNA, 588 bp, Bacillus thuringiensis
atgaattttcagaacaaaagggaggcgtatgtcatggacaacaagcatcaaaaccacatccaaagtgaatcacaagataatccccttgcaactaattttgaacctaacatacaacaacattcaaatgtaaaagaaaagaatcatcgattaccatttagtattgtgttaaatattccaaatggatttcagatacaaaaggaaaagaatcctaaagtgatgtatgatttaaaccatctctctatgataaaagaaacatgtaaaaaatccattgacgtggataattgtggatacgttgatgttgacttacatgcgttaaagataaagggatgtctatcttttttacttaatctatatattgaaccaatccatgatggtaaaatctacgaaaaaaattctaaggatggttctatcgcgttatcttataaagaaacattacatgttgaccacgtagtaaaatatagtgtggggcaattaccttattatattattgatgatgaacatgtccaaatacgccatttagaaatacaagtatttaatgaaaattgtaatatagtaaaaatttccggtgagttttattttgagtatgaa

SEQ ID NO: 90 - protein, 196 aa, Bacillus thuringiensis
MNFQNKREAYVMDNKHQNHIQSESQDNPLATNFEPNIQQHSNVKEKNHRLPFSIVLNIPNGFQIQKEKNPKVMYDLNHLSMIKETCKKSIDVDNCGYVDVDLHALKIKGCLSFLLNLYIEPIHDGKIYEKNSKDGSIALSYKETLHVDHVVKYSVGQLPYYIIDDEHVQIRHLEIQVFNENCNIVKISGEFYFEYE

SEQ ID NO: 91 - DNA, 2250 bp, Bacillus thuringiensis
atgaaggaaagcaataataacgaatatgaagttttagatatgaattcttcatcttatccatctaactcacctcaaacaaacaacaataattttagataccctttttcaaataacgaaaatgatatattacagtataatgattggattaataggaatcaagttagtgatttagagaattttaatgcagataatttagccgcagttagtgcaggtattattgtagttggtacgatattatctgtttttagtggtggagctattccaggagccgctatcatttcttttggaacattgatgcctattctttggccaagtggcgaacaagatagaacagtttggactcagttcatgacacacggatcaaatcttataaatcaacctctaattgatactgttaaagaatcagcattggcaactttaaatggttttagacaagtactaggaaactatgcagatggacttgagtattggcaaaaattaaaacaacagcagattccaggaacaccaccgtcttcagaattgcgacaagctgctcaaacagttaaaactcgatttgaaattgttcataatgactttgttagagatatgtctgactttcaattaccatcttataaggtaattctattaagcacatatgcacaagctgcaaatttacatttaaatttattacaacaaggtgttatatttgcagatcaatggaatgcagatatttacccttctcaagttgtacctgatgtatatgcaggaacctcacaagcatactatgaacttttacaaaaatatttagctgtttatagtaattattgtacaaatacctacaaagaaggtttaaatattcttaaaactcaatctggtgtaaagtggaatacgtataattcatatcgcagagaaatgactataactgttttggaccttgtagcactttttcaaaattatgatgtgaaaagatatccaattggaacccagtctcaacttactagggagatttatacagatgcatttttatcaaactatgcaaataataattttagcttagatagaatagaaactgaattaacaagaccacctcacttatttacttggttaaacaaaataaatttttatacaagaacttataatattgacatgagacaattaggttttctgactgcaaattccataaactattcattaacaaatagtgaaatgaatactagtgtaatatatggttctcacagaagtacagataaattaagctcaatatctattccatttggtagttatatttacaatattttagccacttatcaagtgaattttcccgaccatattcaaaaaatgaattttagtttaactaatcaaaatacattaatttatgaaccggggttttatttagaagactatgaaaaaaggaatacaataatatcatttccagacttagataaaacatttccacctaaatttaatagatacagccatatcctgtcttatatgaaaacatggtatattgcgaatatgcctgtatatgaaacaggtagaaatgtttcttttgcatggacacattatagtgttgatttcgcaaacactattaaagacaaattaattacacaaataccagcagttaaatctagatttttacaaagtgctgatgttgttcagggtcctggtcatacaggaggagatttagtatctatttcaaaacctggttcgtctgtagaacttcaatgtcatgtgcctaatactttacaaaaatataggttacgtatccgatatgcattgtacgctccacagtctctctctacggttactattggggttcgattaacaggatcaaatcctacaattgcttactatgatgaggaagtacgattacctaaaactgtctcatcatttgatggtgcttcaaatctaaaatatgaagactttcaatatttcgatttattctcaaatgttcgattagatatgggaagcacaatttctttgagaatatctcaagatacaataataggatctggtacgataattttagataaagttgaatttatcccttcaaatctatatgagataaaatcatatgaaaaagaaaagctagaaactactatacaacgtgttaattctttatttacaaataaacaaaaaattaatttaaaattcgaaactacatcttatcatatcgatcaaactgcaatttttgcagaagccatttcagatgagttatatgcacaagaaaaaatgatactattagatgaaattaaatatgcgaaacgactg

SEQ ID NO: 92 - protein, 750 aa, Bacillus thuringiensis
MKESNNNEYEVLDMNSSSYPSNSPQTNNNNFRYPFSNNENDILQYNDWINRNQVSDLENFNADNLAAVSAGIIVVGTILSVFSGGAIPGAAIISFGTLMPILWPSGEQDRTVWTQFMTHGSNLINQPLIDTVKESALATLNGFRQVLGNYADGLEYWQKLKQQQIPGTPPSSELRQAAQTVKTRFEIVHNDFVRDMSDFQLPSYKVILLSTYAQAANLHLNLLQQGVIFADQWNADIYPSQVVPDVYAGTSQAYYELLQKYLAVYSNYCTNTYKEGLNILKTQSGVKWNTYNSYRREMTITVLDLVALFQNYDVKRYPIGTQSQLTREIYTDAFLSNYANNNFSLDRIETELTRPPHLFTWLNKINFYTRTYNIDMRQLGFLTANSINYSLTNSEMNTSVIYGSHRSTDKLSSISIPFGSYIYNILATYQVNFPDHIQKMNFSLTNQNTLIYEPGFYLEDYEKRNTIISFPDLDKTFPPKFNRYSHILSYMKTWYIANMPVYETGRNVSFAWTHYSVDFANTIKDKLITQIPAVKSRFLQSADVVQGPGHTGGDLVSISKPGSSVELQCHVPNTLQKYRLRIRYALYAPQSLSTVTIGVRLTGSNPTIAYYDEEVRLPKTVSSFDGASNLKYEDFQYFDLFSNVRLDMGSTISLRISQDTIIGSGTIILDKVEFIPSNLYEIKSYEKEKLETTIQRVNSLFTNKQKINLKFETTSYHIDQTAIFAEAISDELYAQEKMILLDEIKYAKRL

SEQ ID NO: 93 - DNA, 2295 bp, Bacillus thuringiensis
atgaatgttaacgaaagcgatttatatgacattaccgatgcttcgacctgccaatgcccgacagataattttttaaaataccctttggcaaatgatccttattcatccaatttaaatcttaattcttgtcaaaacagtaacgttactaattggataaatatattaggaagcgcagcgagagaagcagtatctattagtagaacagtaatatcacttctcaaagcacctactatctctggattagtttcattagcatataatcttataactagaatgcaaggaggtagcagtggaagatctttatcagagttatctatatgtgacttattagctattattgatttacgagtaaatcagagtgttttaaacgacggaattgcagactttaatggttctttaagcatatatagaaactatttgcaggctttagagagttggaacaatagaccaacatcagctactgctgaagagctacgtactcgttttagaatagctgattctgaatttgatcggattttaacaagggggtctttaacgaatggcggttcgttagctagacaaaatgctcaactattattattaccctcttttgccaatgcagcctattttcatttaatattacttagagatgctataaagtatggatctagttggggattgtttagcactacacctgttatattttatcgagagaaattagtagaacttattaaattatatactaattattgtatacattggtataatcaaggtcttaacgaacttagacaaggaggtactaatgctaatgcttggttagaatttcatagataccgtagggaaatgacattaacggtgctggatatagtttcattatactcaaatattgatattaccaaatatccaatagaaacaaatttagaattgagcagggtcatttatacagatccaattggttttgtaaatcgtggtacttcaagtagattaagctggtttgattggcaaaatagagctaatttttcagaattagaaagggcaataccagatcccgtactttcgcaatttttaaatagtattcgtatatatactggtatactgtcattacctgtttctccaaataccgttagaggacgggtatggtatgggaatcaaaatcaggttagtagtgctaattcacaagatgttttcaatcagactttcggccaagtaacaaatgatagacaaaacctttcaggattaaatatatttagggttgattcgcaagcagctaatctaaataattctttgtatggtgtaagtagagctgaatttttccacgatgctagccaagggtctagaaggtccgtatatcaagggtatattagaactagcgggctagataaccctgtaacgcagactattcgaacttttttaccaggagagaattcggatacaccaactccagaagattatactcatgtattaagtgctgcaataaatttaactggcggccttcgacaaccagtaactaatcgtcgttcttctgtggtgatgtatggatggacacataggagcctaagtcgtgaaaatacaatattttcagatagaatcaatcaatttccggcagttaaagctgtgcaaggcggaggacgaacatttccagttgtaagtggtccaggttttacgggaggagatttagctcaaatgcctagcacaggtgaaggtttatggttcaatggtagagtcgaaccagatgcgttaaataaggcatttcgtgtaagagttcgttatgcggctaatcgtgaggatagactagatttcaatgtacatcaaggaaatagtacaacactatccattcaacgtactatgacaagtgaaataccctcacgttttgaagatttttcctatgctacatttcctggtatattcacatttggaaatgttaattctagttggtttttacgtaggcaaatgggtggtcctgaaaataacagagtttatattgataaaattgaatttatcccaatagatgaaacacgtgaagcagaacaagacctagagaaagcaaagaaagcagtgaatgccttgtttacaaatagaaaagatgccttacaggcaggtgtgaccgactatcaaatcaatcaggctgcaaatttaatagaatgtatatctaatgagttatatccaaatgaaaaacggatgttattagatgctgtaaaagaagcaaaacgtctgagtggggcacgtaacttacttcaagatactgattttcagatggcgtatggggacggagaaaacggatggactacaagtacggggattgaaatagtagaagga

SEQ ID NO: 94 - protein, 765 aa, Bacillus thuringiensis
MNVNESDLYDITDASTCQCPTDNFLKYPLANDPYSSNLNLNSCQNSNVTNWINILGSAAREAVSISRTVISLLKAPTISGLVSLAYNLITRMQGGSSGRSLSELSICDLLAIIDLRVNQSVLNDGIADFNGSLSIYRNYLQALESWNNRPTSATAEELRTRFRIADSEFDRILTRGSLTNGGSLARQNAQLLLLPSFANAAYFHLILLRDAIKYGSSWGLFSTTPVIFYREKLVELIKLYTNYCIHWYNQGLNELRQGGTNANAWLEFHRYRREMTLTVLDIVSLYSNIDITKYPIETNLELSRVIYTDPIGFVNRGTSSRLSWFDWQNRANFSELERAIPDPVLSQFLNSIRIYTGILSLPVSPNTVRGRVWYGNQNQVSSANSQDVFNQTFGQVTNDRQNLSGLNIFRVDSQAANLNNSLYGVSRAEFFHDASQGSRRSVYQGYIRTSGLDNPVTQTIRTFLPGENSDTPTPEDYTHVLSAAINLTGGLRQPVTNRRSSVVMYGWTHRSLSRENTIFSDRINQFPAVKAVQGGGRTFPVVSGPGFTGGDLAQMPSTGEGLWFNGRVEPDALNKAFRVRVRYAANREDRLDFNVHQGNSTTLSIQRTMTSEIPSRFEDFSYATFPGIFTFGNVNSSWFLRRQMGGPENNRVYIDKIEFIPIDETREAEQDLEKAKKAVNALFTNRKDALQAGVTDYQINQAANLIECISNELYPNEKRMLLDAVKEAKRLSGARNLLQDTDFQMAYGDGENGWTTSTGIEIVEG

SEQ ID NO: 95 - DNA, 2313 bp, Bacillus thuringiensis
atgaaccgaaataatcaaaatgattatgaagttattgacgcttccaattgtggttgtgcgtcaggtgatgttgtgaaatatcctttgacaaatgatccgaatgccggattacaaaatatcaattataaagagtacttacaaatgtcagatgagaactacactgattcctatataaatcctagtttgtctattagtgggaaatctgtaatacaagttggaattaacattgtagggaggttgttgagcttttttggattcccatttgctaatcaagtggtcgctgtctatagctaccttttaaacaccttatggccaaataatgatactgaagtatgggaatcttttatggcacaagtagaagaacttgttgatcaaaaaatatcagaagcggtagtagggaccgcattggatcatttatctggattaaactataattatgaattatatgtagaggctttggaagagtggctggaaagaccaaatgccgcaagagccaacctagtttttaatagatttactacactagatagtctatttacgcaatttatgccaagttttggctctggtcctgggagtaataggtatgcagattcattactttcagtatatgcacaagcagcaaaccttcatttgttattcttaaaagatgcagacatttatggagctagatgggggctgaatcaaactcaaatagatcaataccataatcgtcaacaaacccttactcggaattatacaaatcattgtgttactacgtttaatgatggattagagaaaataagaaacacaagcgctgagagttggtttaaatacaatcaatatcgtagagagatgacattaatggcaatggatttagtggcattatttccgtattataatgtacgagaatactcaatggcagtaaatcctcaacttacacgagaggtgtatacagatccaattgcatttgatccatcagaacaaccgaatactcaattgtgtcgaaaatggtatactgcccgctttgtacagaataacgttaatttttctcagttagaaaatgcattcattcgttcaccacatctcttcgaaagattacattctctggaaattaattttataaatggagctaattggtggtggcataaggtaaggaaccaacttttaaataattcattaatactcgaaagagattacggtacatctactgttaattctcctacgactcaacttaccgtgaatacttcaaatgctgatatataccaagtacgttctcgtgcagaaaatccgactgcagctgcaggtacttactattcagttagaggtgttgagttttatttaagctcaggcgttaagagggagttttctggaactacagtcgctcctttggcttgccaagaattgcgaaattcaattgatgagttaccaagtttagaaccaaatgagcctatcatcagaaattatagtcatagattatctcatattacttggtaccaatttagtggccgccaaagtggaaatccgactactaataatggggatatacctacttatgtctggacacatcgcgatgtggactttaataatacaattactcccaatagaattactcaaataccatggataaaggcatctgaaatagctgcgaatactactgtcgtaaaaggcccaggatttacaggaggggatatacttcgaagcacgatccctggtacagttggaacgattagggctaatgttatggccccattaacacaacaatatcgtataagattacgttatgcgtcgacaacaaattttgttgttaatttatttgttaacaattcagctagtggttttactctcccaagtacaatggttcaaaatgagtctttaacatacgaatcgtttaataccgaagaggtgacaagaactattagattttcacagtcagacactacactgagattgggtatattttcgtttgaccctggtcaagaagtgtatgtagataaacttgaaatcgttccaattaatccagctcgtgaggcggaagaggatttagaagcagcgaaaaaagcggtggcgagcttgtttacacgtactagagacggattacaagtaaatgtgacagattaccaagtcgatcaagcggcaaatttagtgtcgtgcttatcagatgaacaatatgggcatgataaaaagatgttattggaagccgtacgcgcagcaaaacgcctcagccgcgaacgcaacttgcttcaagatccagattttaatgaaataaatagtacagaagagaatggctggaaggcaagtagcggcgttactattagcgagggcggtccattcttt

SEQ ID NO: 96 - protein, 771 aa, Bacillus thuringiensis
MNRNNQNDYEVIDASNCGCASGDVVKYPLTNDPNAGLQNINYKEYLQMSDENYTDSYINPSLSISGKSVIQVGINIVGRLLSFFGFPFANQVVAVYSYLLNTLWPNNDTEVWESFMAQVEELVDQKISEAVVGTALDHLSGLNYNYELYVEALEEWLERPNAARANLVFNRFTTLDSLFTQFMPSFGSGPGSNRYADSLLSVYAQAANLHLLFLKDADIYGARWGLNQTQIDQYHNRQQTLTRNYTNHCVTTFNDGLEKIRNTSAESWFKYNQYRREMTLMAMDLVALFPYYNVREYSMAVNPQLTREVYTDPIAFDPSEQPNTQLCRKWYTARFVQNNVNFSQLENAFIRSPHLFERLHSLEINFINGANWWWHKVRNQLLNNSLILERDYGTSTVNSPTTQLTVNTSNADIYQVRSRAENPTAAAGTYYSVRGVEFYLSSGVKREFSGTTVAPLACQELRNSIDELPSLEPNEPIIRNYSHRLSHITWYQFSGRQSGNPTTNNGDIPTYVWTHRDVDFNNTITPNRITQIPWIKASEIAANTTVVKGPGFTGGDILRSTIPGTVGTIRANVMAPLTQQYRIRLRYASTTNFVVNLFVNNSASGFTLPSTMVQNESLTYESFNTEEVTRTIRFSQSDTTLRLGIFSFDPGQEVYVDKLEIVPINPAREAEEDLEAAKKAVASLFTRTRDGLQVNVTDYQVDQAANLVSCLSDEQYGHDKKMLLEAVRAAKRLSRERNLLQDPDFNEINSTEENGWKASSGVTISEGGPFF

SEQ ID NO: 97 - DNA, 1155 bp, Bacillus thuringiensis
atgacaattgtagatattgaacaaggcgctattgattatacgagatggcatatagtaaattatggcttggcatcgcctggcacctcacccaatatgcgttttttcccatacgaattgagagatgttacagctacacctaccggtactctttttaacgtatttccaacaccaaaaataacttccatccaggtactggaaaataatacgaactcaactcaatctcaatctgtcaaattttccgaaaaagtaatcgaatcgactactactagtactactgaaggttacaaaattggggctgggataaaatcaacaactaaattcaaaattaaagtcggctttttagtatcaggtgagttggagcagtcagttgaagtttcccttacatcagaatataatcatagttcaactcaatcagtaaccaggtcggaagaaagattatgggaagtcacacaacccgtatctgttcctccccgctcacgcgtaattgcctctcttgtcataatgggagcagatgtaccaatccctacgttattatctgctaaccttaggggtactggtacctcaggtggagcaaatgcatttttttctgctactttcccaggaacttcaggacagactcgaagttttgggggaccagctgcgttccttgctgatagaaattggccttctagacctgcagctttcagatcttcaggttcagaatctagccttaatttagaaggttactcaactaccttagcaggcacagctttatatagtactgtcagatttgaggaaactccattatcagggtatagtggaccaagaagagtttggtattcaaaccaaatacaattaagagatggcagttttataactctaccatatcttaatccattaacaggaaagatagataattctcagtattttcaagaatataataattctcaagaagactcttataatattcaaaaaacaagtcatgttactcaggagccacttcattacattcaaaattctagtgataatcaagttgattcttacaatatcccaaattattatagtaaccaagctgattcttataatacctcaaattattatagtaaccaagctaattcttataatacctcagattattatagtaataaccaagctgattcttataatacctcagat

SEQ ID NO: 98 - protein, 385 aa, Bacillus thuringiensis
MTIVDIEQGAIDYTRWHIVNYGLASPGTSPNMRFFPYELRDVTATPTGTLFNVFPTPKITSIQVLENNTNSTQSQSVKFSEKVIESTTTSTTEGYKIGAGIKSTTKFKIKVGFLVSGELEQSVEVSLTSEYNHSSTQSVTRSEERLWEVTQPVSVPPRSRVIASLVIMGADVPIPTLLSANLRGTGTSGGANAFFSATFPGTSGQTRSFGGPAAFLADRNWPSRPAAFRSSGSESSLNLEGYSTTLAGTALYSTVRFEETPLSGYSGPRRVWYSNQIQLRDGSFITLPYLNPLTGKIDNSQYFQEYNNSQEDSYNIQKTSHVTQEPLHYIQNSSDNQVDSYNIPNYYSNQADSYNTSNYYSNQANSYNTSDYYSNNQADSYNTSD

SEQ ID NO: 99 - DNA, 2883 bp, Bacillus thuringiensis
atgaaactcaaaaatttatttaaatgtcttacaattacagcgatattatctcaaattgctgtatcacccgtaacatcttctgctgaaagaagtaacgaaaaaaaagtagctaataaaacaaatatggaagagaaaaataatatacaaggactattgggatattattttaaagatgctcaatttcgggatttagcttctattaaggttggtgaacaaagtaataaactaatagatgagacaaaagtaatgaagaataatcaaattattcatgccgtacgttggatgggaagagtgaagccaacccagaccggagaatatatactttctacatcatctgataaaaacattatgttacaaattaatggggaaactattataaaccaaggtaagatggaaaaacctcttaaattagagaaaggtcaggtatatgaattaaagattgaatatcgaaatgcagcgaatactttgtctgatttacaattattttggtcaatagatggaaaagaaaaagagcaaatttcacaaaaaaatattttatctcccgatttttccgaaaaagaaaaattatcaagtgataaaaaaggattgtcgttattacctaattttactctatttgataataaaccctttgaagcagaattaaaagacgcagatcaagatggaatccctgacgaatgggagatacaaggttatacatttaaagatcaacaaattgtaaaatgggatgatgcatatcttgtacaagggtacaaaaaatatgtatcgaatccaaataaggctcgaactgtcgccgatccatatacagattttgaaaaagtaacagggtatatgcctgcagcaacaaaagatgaagctagagatcctttagttgctgcttatccagctgtaggagtagggatggaaaaattactattttctaagaatgaaaatgtaacagaagggacttctgggaccaagtccaaaagtgtaacagatacaaatacgaacacaaatactgtagagattggtggaaatataggatggagtgataagggtttttcatttcaaatttcaccaaagtactcacatacttggaccaatagtacagcaatccaaaattcagaaagtgaatcttggtcaaatcaaatcggaattaacaccgcagaatctgcctatttgaatgcaaatgtacgttattataatgcaggaacagcacctatttatgacttgcgtcctacttcgaactttgtatttcaaaactcaggtacttccattgcgacgataacagctggaccaaatcaaatcggaaatagcttgggacctagtgatacatatccaacaaggaatcaagcacctatctctttagataaggcaaacgaatcaggaacagctaaaatagctgtaaatgcagatcaattagatgctcttcaagatggcagggaaacattaaacttagaaacgacgcaaaacaaaggacaatatggtgttttggatgctacaggtaatctagttacagacgcatctaaacaatgggaccctattcgaacaaatattgatgcagtctcaggttccttagcgctgcattatggtactagtaaagaaagtttagaaagaagggttgccgcaaaaaatgaaaatgaccctgaagataaaacacctgagattacgataggagaagcgataaaaaaagcatttaatgccaaagaaaaagatgggcgattatactacacggatcaaacaggaaaagatgtatgtctagatgagtcagcagtaaatctcattggggatgaaaaaacacaaaaagaaattgaaaagcagctagatcaaatgcaagataaaaaagtatataatgcgaagtggaaacgaggtatgaatattactcttcacatgccaactgtttattatgattttgagaaagatggtgatactgaatggaacaatatttctcaaactaatataggatatacaggtaaaaaaagtggagaaattgatcagaatggaaatggatatgcaaaaaaagatcttgaattgaaaccatatacaagttatacagctcgtgcatatgttagaacagcatcccaaccaggtaaaaacaatgtaatattctacgtagatagcaacacgaatgggaatggaaaaggtgcaaaacaaagcgtaacaattgagggggataaatgggagttgatagaattttctttcaacacaacagggaatccagagtatttcaagaaattaggtcttaaaaataatggaaatacaaaactgtatattgatgatgtatccgtaacagaatggaaacagggcgaagacattcaaaaacttcatgtgtttgaaaaatggaatccaaatcttaatggatatggtggagtatcttcaattacattttctaaagttccaaatacaaaagttcgatatcaatggggagctattaactctctagggaatgagatatggtctgatattatgcctgccagagatacaggtgagaatggtaaaaggactgtggatataggattgtaccatgctggggctaagctatatgctgtagatcaatacaatgataatttgaaagttgaaattgcacagtattttccaataggatatgaacatcatgtggataaaaattggaacaaagttaaacacaacaataaagaatatataaatggtataacttttaaaaaggtaacagataaaaaagttagatataaggtagtagtaaattatacggacaataaaggtataaaacctgcatatgaaatagactctcaggggaatagatatgtaaatttgttagaatataataatggaaaaggaattccagcagatgtttcctctatagcagtttatgttgtagatgaaaaggatgataatatttttgataaagttgcagaatatcatccttgg

SEQ ID NO: 100 - protein, 961 aa, Bacillus thuringiensis
MKLKNLFKCLTITAILSQIAVSPVTSSAERSNEKKVANKTNMEEKNNIQGLLGYYFKDAQFRDLASIKVGEQSNKLIDETKVMKNNQIIHAVRWMGRVKPTQTGEYILSTSSDKNIMLQINGETIINQGKMEKPLKLEKGQVYELKIEYRNAANTLSDLQLFWSIDGKEKEQISQKNILSPDFSEKEKLSSDKKGLSLLPNFTLFDNKPFEAELKDADQDGIPDEWEIQGYTFKDQQIVKWDDAYLVQGYKKYVSNPNKARTVADPYTDFEKVTGYMPAATKDEARDPLVAAYPAVGVGMEKLLFSKNENVTEGTSGTKSKSVTDTNTNTNTVEIGGNIGWSDKGFSFQISPKYSHTWTNSTAIQNSESESWSNQIGINTAESAYLNANVRYYNAGTAPIYDLRPTSNFVFQNSGTSIATITAGPNQIGNSLGPSDTYPTRNQAPISLDKANESGTAKIAVNADQLDALQDGRETLNLETTQNKGQYGVLDATGNLVTDASKQWDPIRTNIDAVSGSLALHYGTSKESLERRVAAKNENDPEDKTPEITIGEAIKKAFNAKEKDGRLYYTDQTGKDVCLDESAVNLIGDEKTQKEIEKQLDQMQDKKVYNAKWKRGMNITLHMPTVYYDFEKDGDTEWNNISQTNIGYTGKKSGEIDQNGNGYAKKDLELKPYTSYTARAYVRTASQPGKNNVIFYVDSNTNGNGKGAKQSVTIEGDKWELIEFSFNTTGNPEYFKKLGLKNNGNTKLYIDDVSVTEWKQGEDIQKLHVFEKWNPNLNGYGGVSSITFSKVPNTKVRYQWGAINSLGNEIWSDIMPARDTGENGKRTVDIGLYHAGAKLYAVDQYNDNLKVEIAQYFPIGYEHHVDKNWNKVKHNNKEYINGITFKKVTDKKVRYKVVVNYTDNKGIKPAYEIDSQGNRYVNLLEYNNGKGIPADVSSIAVYVVDEKDDNIFDKVAEYHPW

SEQ ID NO: 101 - DNA, 1998 bp, Bacillus thuringiensis
atgaattcatatcaaaatacaaatgaatatgaaatattggaatcttcatcgaataacacaaatatgccaaacagatatccttttgcaaatgatcgggatatgtctcctatgtcttggaatgattgtcagggaacctcatggcaagatgtgtgggaatcaagcacgagtatcgcaggtattgggatagatcttataaattttgtggcagaacctagtttaggtggagttaatttattattttcgataataggaaaactaattccacctaatcgtcaatctatttcagcactttctatatgtgatttattatctataattcgtaaagaggtagccgagagtgtgttaaatgccgcgattgcagattttaacggtaaattgaaaaattatagagagtattatctttcttatcttgaggcttggcttaaagacggtaaaccactcaaaaagacgaataattccgacatcggaaaattagttgaatatttcgaactttcagaaagggaattcaatgaaattctaggagggtcattagcaagaagtaatgctcaaatattgttattacctacttttgcacaagctgcaaatgtgcagttattactattaagggatgcagttcaatataaagaacaatggttcccatttttgagtgcagagaatgtaaaatcggaattaaaatcacctaacagtggttgtgattttactggcgattactatgagcgattaaaatgtaaaacagcagagtataccaattattgtgtatattggtatcaggcaggtttagatcagataaaacaggcgggtacaggtgctgacacctggtcgaaatttaataaatttcgtagagaaatgacgttagcggtattggatattatcgctatatttccaacttatgattttgagaaatatccattagcaacagatgtagagttaactagagaaatttatacagatgcagtgggatattcatcgggaacttatagctggttaaactattggaccggtgcttttaatgcgttagaagctaatggaacacggggacctggtttagttacttggcttagcagtataggtatatataatgagtatgtttcgagatattttagcggctgggtaggaactcgtcattatgaagactacacaaagggtaacggtacttttcagcgtatgtctggaactacgagtaatgatctacgtaatgtgactttttcccctttcgatatatttaaaattagttcattagccatcatgaacctagcaggagagactaaccctagaccagagtatcgtgtttcacgtacagaatttagtagtacgtcattaccatctaaacacctgtatgatgcaaataataatgggctaagccgaatgacaattgaatctacgttaccaggtatttggaatccgaaacctagttatacagattactctcacagattatcaaatgcggcatgtgttgtatatggaaattccagagttaacgtatatgggtggacacatacaagtatgtcaaaacataatccaatttatccagataaaatttcacaaataccggctgtgaaagcatttgctttagaatcaggcgcttatgttagcgctggacctggtcatacaggaggaaatgtagtatggttaccatatttagggcgtttaaaaatacgtttaacttctgcgcccacgaataaaaattaccgtgttagagttcgctatgcaggtttgtactcaggtcgtttaatggtacaaagatggtcgctgagtgggtctgcaactggtgattttccttattcatctacgggttctaataatacatttggatatgtggagaccttagttactacatttaatcaatcaggtgttgaaataattatacaaaatcaaacttctccacaacttatcattgacaaaattgaatttatcccagttgatctaacaaatttagaatatgagggagaacaaaacctagaaaaaacaaaaaacgcggtgaacgatttatttatcaat

SEQ ID NO: 102 - protein, 666 aa, Bacillus thuringiensis
MNSYQNTNEYEILESSSNNTNMPNRYPFANDRDMSPMSWNDCQGTSWQDVWESSTSIAGIGIDLINFVAEPSLGGVNLLFSIIGKLIPPNRQSISALSICDLLSIIRKEVAESVLNAAIADFNGKLKNYREYYLSYLEAWLKDGKPLKKTNNSDIGKLVEYFELSEREFNEILGGSLARSNAQILLLPTFAQAANVQLLLLRDAVQYKEQWFPFLSAENVKSELKSPNSGCDFTGDYYERLKCKTAEYTNYCVYWYQAGLDQIKQAGTGADTWSKFNKFRREMTLAVLDIIAIFPTYDFEKYPLATDVELTREIYTDAVGYSSGTYSWLNYWTGAFNALEANGTRGPGLVTWLSSIGIYNEYVSRYFSGWVGTRHYEDYTKGNGTFQRMSGTTSNDLRNVTFSPFDIFKISSLAIMNLAGETNPRPEYRVSRTEFSSTSLPSKHLYDANNNGLSRMTIESTLPGIWNPKPSYTDYSHRLSNAACVVYGNSRVNVYGWTHTSMSKHNPIYPDKISQIPAVKAFALESGAYVSAGPGHTGGNVVWLPYLGRLKIRLTSAPTNKNYRVRVRYAGLYSGRLMVQRWSLSGSATGDFPYSSTGSNNTFGYVETLVTTFNQSGVEIIIQNQTSPQLIIDKIEFIPVDLTNLEYEGEQNLEKTKNAVNDLFIN

SEQ ID NO: 103 - DNA, 2157 bp, Bacillus thuringiensis
atgaaatcgaagaatcaaaatatgtatcaaagtttttgtagcaatgcgacagttgataaaagttttacagatccactagaaaataacacaaatatggaattacaaaactctaatcatgaagattgtttgaaaatgtctgagtatgaaagtgtagagccgtttgttagtgtatcaacaattcaaatgggaattggtattgctggtaaaatccttggtaacctaggcgttccctttgctgggcaagtagctagcctctatagttttatcctaggtgagctttggcccaaagggaaaagccaatgggaaatttttatggaacatgtagaagagcttattaatcaaaaaatatcgacttacgcaagaaacaaagcacttgcagatttaaacggattaggagatgctttagctgtctaccatgaatcgcttgaaagttgggttgaaaatcgtaataacacacgagcgaggagtgttgtcaaaaaccaatatatcgcattagaattgatgtttgttcagaaactgccttcttttgcagtatctggtgaggaagtaccattattaccgatatatacccaagctgcaaatttacatttgttactattaagagatgcatctgttttcggaaaagaatgggggctagcagattcagaaatttcaacattttataaccgccaagtcgaacgagcaagcgattattccgaccattgtgtaaaatggtataatacgggtataaataacttgaggggtacaaatgctgaaagctgggttcgttataatcaatttcataaagatatgacattaatggtattagatttagtcgcgctattcccaagctatgatacacttgtatatcctattaaaactactgctcaacttacaagagaagtatatacagacgcaattgggacagtacatccgaatgcaagttttgcaagtacgacttggtataataataatgcaccttcgttttctgccatagaggccgctgttatccgaagcccacatctacttgactttctagaaaaagttacaatttacagcttattaagtcggtggagtaacactcagtatatgaatatgtggggagcacatagacttgaattacgaacaataggaggggcattaaatacctcaacacaaggttctaccaatacttctattaatcctgtaacattacagtttacgtctcgagacgtatataggactgaatcatgggcaggactgaatctatttttaactcaaccagttaatggagtacctagagttgattttcattggagatttcccacacttccgattgcatctgataattcttattatccagggcatgttggagttgggacgcaattacaagattcagaaactgaattaccaccagaaacaacagaacgaccaaattatgaatcttacagtcatagattatctcatataggactcatttcagcatcacatgtgaaagcattggtatattcttggacgcatcgtagtgcagatcgtacaaatactattgagccaaatagcattacacaaataccattagtaaaagcattcaatcttccttcaggtgccactgttgttagaggaccaggatttacaggtggggatatctttcgaagaacgaatacgggtacatttggggatatacgagtaaatattaatccaccatttgcacaaaggtttcgcgtaaggattcgctatgcttctactacagatttacaattccatacgtcaattaacggaaaagctattaatcaaggtaatttttcagcaactatgaatagaggagaggccttagactatagaacctttaggactgtaggctttactactccatttagcttttcagatgcacaaagtacattcacaataggtgcttggagcttctcttcaggtaacgaagtttatatagatagaattgaatttgttccgatagaagtaacatatgaggtagagtatgattttgaaaaagcgcaagaggaggttactgcattgtttacatctacgaatccaagagggttaaaaacaaatgtaacggattatcatattgaccaggtatcaaatttagtagagtctctatcagatgaattctacctcgatgaaaagagagaattattcgagatagttaaatatgcgaagcaactccatattgagcgtaacatg

SEQ ID NO: 104 - protein, 719 aa, Bacillus thuringiensis
MKSKNQNMYQSFCSNATVDKSFTDPLENNTNMELQNSNHEDCLKMSEYESVEPFVSVSTIQMGIGIAGKILGNLGVPFAGQVASLYSFILGELWPKGKSQWEIFMEHVEELINQKISTYARNKALADLNGLGDALAVYHESLESWVENRNNTRARSVVKNQYIALELMFVQKLPSFAVSGEEVPLLPIYTQAANLHLLLLRDASVFGKEWGLADSEISTFYNRQVERASDYSDHCVKWYNTGINNLRGTNAESWVRYNQFHKDMTLMVLDLVALFPSYDTLVYPIKTTAQLTREVYTDAIGTVHPNASFASTTWYNNNAPSFSAIEAAVIRSPHLLDFLEKVTIYSLLSRWSNTQYMNMWGAHRLELRTIGGALNTSTQGSTNTSINPVTLQFTSRDVYRTESWAGLNLFLTQPVNGVPRVDFHWRFPTLPIASDNSYYPGHVGVGTQLQDSETELPPETTERPNYESYSHRLSHIGLISASHVKALVYSWTHRSADRTNTIEPNSITQIPLVKAFNLPSGATVVRGPGFTGGDIFRRTNTGTFGDIRVNINPPFAQRFRVRIRYASTTDLQFHTSINGKAINQGNFSATMNRGEALDYRTFRTVGFTTPFSFSDAQSTFTIGAWSFSSGNEVYIDRIEFVPIEVTYEVEYDFEKAQEEVTALFTSTNPRGLKTNVTDYHIDQVSNLVESLSDEFYLDEKRELFEIVKYAKQLHIERNM

SEQ ID NO: 105 - DNA, 2205 bp, Bacillus thuringiensis
atgaatcctaataataatgaatacgaaattatagattcaaacacttcaccttatccttcgaacagaagcattaatcattttagatatccttacacaaataatccaaatcaaccattacaaaacacgaattacaaagattggcttgatttgtgtcaacaaaatcaacaatatagtggaaatcttgaaacatttgctagtgctgatacaattgctgcagttagtgcaggtactattgtatccggtactctgttagccggtgtaggtgggctcactgctatatccggacccataggattaatcggtgctataataatatcttttggtaccctactgcctatcttttggccacagggagaacaagacaaaacagtctggacacaattcattagaatgggagaaattcttgttgatacaacgttgtcagaaactgtaaaagaactaaagttaggaactttagaaggaattagacaaatattaaaaagctatgaagatggattaaacgattggataagattaaaaaaacaacaagctcctggattaccaccatcatcacaattacaacaagctgcctctactgttaaacaacgatttgagaatgttcataatgattttatacgagaaatacctggtttccaacttgaaacttataaaacgctattattacctatttatacgcaagttgctaatatgcatttaaatttgttacaacaaggtgttgaatttgctgatcaatggaatgcagatatacatccttcacaaattgaacctaatgctggaacatcaaatgactattataaacttttaaaagaaaatatacctaaatatagtaactattgtgcaaatacctatagaacaggactaaataatcttagaaacgaacctgatataagatggagtatatttaatgattatcgaagatatatgactattactgtattagataccatctctatattttctttatatgatataaaaaaatatagagatacaataggaggaatacaaggcattaactatgaactcacaagagaaatttatacaactgaaataaattttgaccgtattacttcccctaaagttcaacccgatctctataccatggaatataatttaacacgttcaaggcttagattattttcatttttagatgagcttatattttatacagcaaatgaaacatacgggaatcgtttagttggtattgcgaatcataatagatatacttatgctacaacaggaactgaaattatatatggaaaaagaacaggtccacccacaacaaaaattttaagaccatttgaatcttataaagtttcaattgtaactgatagacaagtacaacctactgccccttttaataacatatactttataattaatcaaattgaactttatttaaataattcacctagtaataaattaacatattcagctgggggaaatttatctaatgataaaaaaacaactgattttcaatttcctgtaaaaaaagactgtaaacaaattactgatccaaattgtttaccaagctataatagttatagtcatattttatcccagttttctttatatacttattcctatctaactggattagcggtaactacattatatacaggtgcattaggatggacacacagtagtgttaatagaaataatgcaatatcagataaaataattacaatgatcccagcaatcaaaggtaacagtcttgatacaaactccaaggtaattgaaggacctggtcatacaggaggaaacttggtttatttacaaagtcaaggacatttagagattacatgtagaactcctaattctacacaatcttattacattagacttcgatacgctacaaatggtgctggaaatactcttcctaatatatctcttacaataccaggagtaacaggaataccacctctacgactcaacaacactttttctagtacaaattataataatttacaatatgaaaactttgagtatttccaatttccaggtacaataacattacctttaaatcgaaacatacaatgtatatttaatcgtgcagatgtatcaaattcaattttaatcattgataaaattgaatttataccaattacttcctctatacaccaaaatagagaaaaacaaaaattagaaactatccaaacaaaaataaatacattttttacaaatcatgagggtgttgcaaaactaaaa

SEQ ID NO: 106 - protein, 735 aa, Bacillus thuringiensis
MNPNNNEYEIIDSNTSPYPSNRSINHFRYPYTNNPNQPLQNTNYKDWLDLCQQNQQYSGNLETFASADTIAAVSAGTIVSGTLLAGVGGLTAISGPIGLIGAIIISFGTLLPIFWPQGEQDKTVWTQFIRMGEILVDTTLSETVKELKLGTLEGIRQILKSYEDGLNDWIRLKKQQAPGLPPSSQLQQAASTVKQRFENVHNDFIREIPGFQLETYKTLLLPIYTQVANMHLNLLQQGVEFADQWNADIHPSQIEPNAGTSNDYYKLLKENIPKYSNYCANTYRTGLNNLRNEPDIRWSIFNDYRRYMTITVLDTISIFSLYDIKKYRDTIGGIQGINYELTREIYTTEINFDRITSPKVQPDLYTMEYNLTRSRLRLFSFLDELIFYTANETYGNRLVGIANHNRYTYATTGTEIIYGKRTGPPTTKILRPFESYKVSIVTDRQVQPTAPFNNIYFIINQIELYLNNSPSNKLTYSAGGNLSNDKKTTDFQFPVKKDCKQITDPNCLPSYNSYSHILSQFSLYTYSYLTGLAVTTLYTGALGWTHSSVNRNNAISDKIITMIPAIKGNSLDTNSKVIEGPGHTGGNLVYLQSQGHLEITCRTPNSTQSYYIRLRYATNGAGNTLPNISLTIPGVTGIPPLRLNNTFSSTNYNNLQYENFEYFQFPGTITLPLNRNIQCIFNRADVSNSILIIDKIEFIPITSSIHQNREKQKLETIQTKINTFFTNHEGVAKLK

SEQ ID NO: 107 - DNA, 2163 bp, Bacillus thuringiensis
atgataggaataagggggaaaaatatgaattcatatcagaataagaataacgatgaaatactgagttcttcgtcaaaccagtctaacatgttcaatgcttatccaaaatacccactagcttcgatgcagaatacgaattataaagagtggatgaatcagagtgaaaatattactccttcttcatttactgcaatattcactgcattaagaattgttaacggcgcaatttcttttttgggagtatcaagtgaattagaaacatcttttcaagtaatttcacgtttattgggatttattaatagaggaacaggaaatgatttattaactcttacagaacaactcattaatcaaacattagcaacacagtataggaatgcagcaacaggggcggtatatgctatagctagggcatatgaagactatttgaaatggtttagacaatggcaagcgaatccaaccgcacaaaatggtagtcaattagagactgaatttggaacggttaatactttatgtattagtgttttaacttatggcaatacacttgctcgtaggggatttgaaacacttttattaccaaactatgcagtagcagcaaattttcatttgttattattaagagatgctgctctttttagagatagctggacagaaacttctaatttgacaaaagacttaaatcttggaagattaagagattccataagagaatatagcaatcattgtaaaaggtggtatgaagatggtttaaacagactccggaatgcaaggccgggcgatccttttggtccaaggggagatgattggattagatttaatgcttatcgtagagacatgacgttggcggtattagatcttgttacaatatttccaacttatgaccctagtttatttccaggttcaacaagtgttcaattatcaaggatagtttatacagatccagtagctttagcgcagccccaagaatggttttttcgtgacttggaacatgctttaactttccgtggtacagtttctttcttgaatgaaatggatgtatattattggtactattttagacctcataatgtggataggaattattgggctggtaatcgtaattttttaagcaacaggacttcggttcttactggccaatctacttcggcgcgaagaagattggatatgaaaaatagggatattttcagggtagatatgtcgagtcatgaaggtggtgcttttaatgataactatagaggtattcatagggctaatttcttaggtgtaaatatacaaacgaatcaagcaacaaatgtattatttcaagtgaattttaatgctaatggttttcaacacaataatcattctagatttttaccaggagaagaacgtgaagtaccaaatgcaaatgattatactcataggttattccaagtgctgaatgctgtccatactacacataatgtacgtacaacatttttttcacatgcatggacgcataaaagtttaacccgtcaaaatacatttagtgctgataaaattttacaaataccagctgtaaagacagtaagcaatagtgctgaacgtgctgtaatatcaaatactggagaaaatgtaataaaattggataacttgactacaaatttattatatccattaacatcggctgatttacaatcatcaaatacacgttttattgtgcgtattcgttatgctagtatgagtaataatagattgaatcttcttttaaatgatgctcaagtagcattactaaatgcggagcgtacagtgcggagtgggggagcactagacaatcttcaatatgaagattttaaatatgctacatttgcaggtaatttcaagatgggttctcattctatattaggtatttttaaagagacatctaatacagaatttgtattagataaaattgaattaatcccagttggtacttttgcaaatcaactattagaagaaacaatagattacaacaaagattgccaccagaattctagtattatgtatgatcaaaacttcaacacttatgaccagaacatggagaatacgtatgatcaaagctataacacttatgaccagaacatggagaatacgtatgatcaaagctataactataatcataatcctagctgtacatgtaaccaaggttataacaataaccgtcctaaa

SEQ ID NO: 108 - protein, 721 aa, Bacillus thuringiensis
MIGIRGKNMNSYQNKNNDEILSSSSNQSNMFNAYPKYPLASMQNTNYKEWMNQSENITPSSFTAIFTALRIVNGAISFLGVSSELETSFQVISRLLGFINRGTGNDLLTLTEQLINQTLATQYRNAATGAVYAIARAYEDYLKWFRQWQANPTAQNGSQLETEFGTVNTLCISVLTYGNTLARRGFETLLLPNYAVAANFHLLLLRDAALFRDSWTETSNLTKDLNLGRLRDSIREYSNHCKRWYEDGLNRLRNARPGDPFGPRGDDWIRFNAYRRDMTLAVLDLVTIFPTYDPSLFPGSTSVQLSRIVYTDPVALAQPQEWFFRDLEHALTFRGTVSFLNEMDVYYWYYFRPHNVDRNYWAGNRNFLSNRTSVLTGQSTSARRRLDMKNRDIFRVDMSSHEGGAFNDNYRGIHRANFLGVNIQTNQATNVLFQVNFNANGFQHNNHSRFLPGEEREVPNANDYTHRLFQVLNAVHTTHNVRTTFFSHAWTHKSLTRQNTFSADKILQIPAVKTVSNSAERAVISNTGENVIKLDNLTTNLLYPLTSADLQSSNTRFIVRIRYASMSNNRLNLLLNDAQVALLNAERTVRSGGALDNLQYEDFKYATFAGNFKMGSHSILGIFKETSNTEFVLDKIELIPVGTFANQLLEETIDYNKDCHQNSSIMYDQNFNTYDQNMENTYDQSYNTYDQNMENTYDQSYNYNHNPSCTCNQGYNNNRPK

SEQ ID NO: 109 - DNA, 1848 bp, Bacillus thuringiensis
atgaaaaaaagtatatttacgctatcaaccgcagcttttttttccaccggggcggctacacttgttcatgcagctgaacagcatgttgttaaaccaggtgaaacattagacagtattgctaaacagtatgaaatggacgtcagcacattgaaggcattaaacaatttagaaaatgacgctctccaagtaaatcagaccttaacggtagctagccattcttccggggcttccgaaagcacgcacattgttcaagctggcgagacgattcacgccattgcccagctgtaccagatgccagaaacagaattaaagcaattgaatcagctggaaaacaacacaatttatgcaggacagaaactaaaggtaagcggaaataaggctgtccatcagtctgctgccgttcagcgtcctctcccagaagcagaattacatacacaagcagccaagccagctgtagaagcagaagttaaagagctgcctgtgacaggaacatacatagtacagcgaggggatacactgggagctattgcaagagcttatcagatggagccagcccagcttcggcaattaaacggacttgaaaatgactctatttatgctgggcaaacattgaagataagcagccagacggttgctgaaaaggaaccgccggcgctgtctgcaaggatcgcttctgccggtacttatacaataaagagcggagattcgcttggtgccattgcaaaagcgcataatatgacagtggctgaactgcagaagctgaatggactggcgtcccacatgatttatgcaggccaaacgctcaaggtgaagggcaaaccggcggctgcgaagccctcacagccaaaaccgaagccatcggtgacgccatcgccatcttctggcggttatacagtcaaaagcggtgattcgctaagtcttattgcgaaaaggcatcaaatgagcgtgacggaattaaagcagcttaatcaattggcatcagaccttatatttattggccaaaagctcaaggtgagcggcaagccgacaccgtctcagccgaaaccaaagccgccggccgcgccacagccatcttccggcagttatacggtcaaaagcggcgattcgttaagtctcattgcacaaaagcatcaaatgagcttagcagagttaaagcagctcaatcaattaacgtctgatatgatatttattggccaaaatctcaaggtgagcggcaagccaggagcgaacaagccgacaccgtcccagccgacaccgaagccgccggtgacgccatctccgtcctccggcaattatacggtcaaaagcggtgattcgctaagcctcatcgcccaaaagcatcaaatgagcttagccgaattaaaaaggctgaatcaattaacatctgatatgatatttgccggccagatcttaaagatcagcggcggagggtcagggacgggcacgcctccttccagcaagccaggctcttctggcggcggggcgttttccgtggcgtcattgattgcagaggctaagaagcatctcggcactccttatgtatggggcggcgttcagccctccggctttgattgcagcggcttcatttactatgtatttaataaagccggcaagagcatcccgcgcaccaatacggaaggctactacagccgttcctactatgtcgataagccgcaggtaggcgacttggtattcttcgtaaatacgtataaaaaaggcatttcccacatgggcatctatattggcggcaaccagttcattcaggcgagctcttcacaaggaattaccatcacgagtctggataacagttactttaagcagcggtttgacagctttaagcgcttttac

SEQ ID NO: 110 - protein, 616 aa, Bacillus thuringiensis
MKKSIFTLSTAAFFSTGAATLVHAAEQHVVKPGETLDSIAKQYEMDVSTLKALNNLENDALQVNQTLTVASHSSGASESTHIVQAGETIHAIAQLYQMPETELKQLNQLENNTIYAGQKLKVSGNKAVHQSAAVQRPLPEAELHTQAAKPAVEAEVKELPVTGTYIVQRGDTLGAIARAYQMEPAQLRQLNGLENDSIYAGQTLKISSQTVAEKEPPALSARIASAGTYTIKSGDSLGAIAKAHNMTVAELQKLNGLASHMIYAGQTLKVKGKPAAAKPSQPKPKPSVTPSPSSGGYTVKSGDSLSLIAKRHQMSVTELKQLNQLASDLIFIGQKLKVSGKPTPSQPKPKPPAAPQPSSGSYTVKSGDSLSLIAQKHQMSLAELKQLNQLTSDMIFIGQNLKVSGKPGANKPTPSQPTPKPPVTPSPSSGNYTVKSGDSLSLIAQKHQMSLAELKRLNQLTSDMIFAGQILKISGGGSGTGTPPSSKPGSSGGGAFSVASLIAEAKKHLGTPYVWGGVQPSGFDCSGFIYYVFNKAGKSIPRTNTEGYYSRSYYVDKPQVGDLVFFVNTYKKGISHMGIYIGGNQFIQASSSQGITITSLDNSYFKQRFDSFKRFY

SEQ ID NO: 111 - DNA, 177 bp, Bacillus thuringiensis
atgaccttgattatggaaaaaacacaattttgtttgctaagatgtatatatagcttaattattaaaaggcccttagaaaaaacgtatttaaatttaaagttaatgaattgtaaggaaaggcacttcattatcacctcgttatgtcatagaagaattagaatgtttcccagaaataga

SEQ ID NO: 112 - protein, 59 aa, Bacillus thuringiensis
MTLIMEKTQFCLLRCIYSLIIKRPLEKTYLNLKLMNCKERHFIITSLCHRRIRMFPRNR

SEQ ID NO: 113 - DNA, 1677 bp, Bacillus thuringiensis
atgtttacaagtggcgaaaaaaataggttgaaaatagtaacgactgattatgaaatagatcaagtggcaaattcgatagaaaatatgtcaaatgaacaacattcacaagagaaagcgatgctatgggatgaagtgaaacatgccaaatacctcagtcagtctcgtaatttactccaaaatggtgattttgaggatttatttagcagctggactacaagtaatcacatgttcattcagacagataattcaacttttaaaggaaattatctcaatatgtctggagcaagaaatatcgatggaaatatatttccaacctatatctatcaaaaaatagatgagtctagattagaaccatatacacgttatcgagtacgagggtttgtggggagtagtaaaaatctggaattaatggtaacgcgttactggaaagaaattgatgctattatggatgttccaaatgatttggcctatatgcagcctagcccttcacgtggagattattactgcgaatcatcgtcccagtatgtgagccaagggtatcctacacgagtaacagatggatatgcttctgataagtatgtatgccagccaaatctaggtaaaaaacatgtgaagtatcacgatcgtcatccatttgattttcatattgacacaggacaattagatacaaatacaaacttaggcgtttgggtcttgtttaaaatttccaattcagatggatatgctacattagggaatctagaagtagttgaagaaggaccactaacgggtgaatcattgtcacatgtgaaacaaaaggaaaagaaatggcatcaacacatggagaaaaaacgtatggaaacacagcaagcctacgatccagcaaaacaggctattgatgcattatttacaaatgaacaagagttacactatcatattactttagatcatattcaaaacgctgatcgactgatacagtcgattccctatatataccatgcttggttaccggatgctccaggtatgaactatgatatgtatcaagggctaaacgcaagtatcatgcaagcacgctacttctatgatgcacgaaatagtataacaaatggtgactttacacaaggattaacgggatggcacgcaacaggaaaggcaacggtacaacaaatggatggaacttcagtattatttctatcaaattggagtgcgggggtatctcagaacctgcatgcccaaaatcatcatggatatgtgctacgtgcgattgccaaaaaagaaggacctggaaaagggtatgtaacattgatggattgtaatggcaagcaggaaacactgaagttcacttcttgtgaagaaggatatatgacaaaaacagtagaggtatttccagaaagtgatcgtgtacgaatagagattggagaaaccgaaggtacgttttatatagatagcatcgagttgatttgtatgaaaggcaataataacccgcacacggataatatgtatgagcaaagttataatggaaattataatcagaataagagcgatgtatatcaccaaggatatacaaacaactatcaccaagactctagtaatatgtataatcaaaattataatcaaaattatactcacaatgatgaccagcattccgattgcacatgtaaccaaggacataactctggctgtacatgtagtcaaaga

SEQ ID NO: 114 - protein, 559 aa, Bacillus thuringiensis
MFTSGEKNRLKIVTTDYEIDQVANSIENMSNEQHSQEKAMLWDEVKHAKYLSQSRNLLQNGDFEDLFSSWTTSNHMFIQTDNSTFKGNYLNMSGARNIDGNIFPTYIYQKIDESRLEPYTRYRVRGFVGSSKNLELMVTRYWKEIDAIMDVPNDLAYMQPSPSRGDYYCESSSQYVSQGYPTRVTDGYASDKYVCQPNLGKKHVKYHDRHPFDFHIDTGQLDTNTNLGVWVLFKISNSDGYATLGNLEVVEEGPLTGESLSHVKQKEKKWHQHMEKKRMETQQAYDPAKQAIDALFTNEQELHYHITLDHIQNADRLIQSIPYIYHAWLPDAPGMNYDMYQGLNASIMQARYFYDARNSITNGDFTQGLTGWHATGKATVQQMDGTSVLFLSNWSAGVSQNLHAQNHHGYVLRAIAKKEGPGKGYVTLMDCNGKQETLKFTSCEEGYMTKTVEVFPESDRVRIEIGETEGTFYIDSIELICMKGNNNPHTDNMYEQSYNGNYNQNKSDVYHQGYTNNYHQDSSNMYNQNYNQNYTHNDDQHSDCTCNQGHNSGCTCSQR

SEQ ID NO: 115 - DNA, 2040 bp, Bacillus thuringiensis
atggcaaatggaaacaataacaacacgtacaattctggaaatactgagaacaacggatatatgaatgataatacttacaatcctgaaagtgctaataacaacgaatacactaataaagatctatacacaagtagctttatagattcaaatcccctgagttgcgaggacccaaatcttgatacgtgtaaacaaaacatttgtaaaggaaacaacggtcaaattggtcccactgtagttcctgttattgtcgcaccgattgtattaacacctgcttttataggatttggaaagtttttattgtcaagtgtaaaggattgggcattagaagaaggattaaaacgcgtgaaagagtggttatttccaagtaataacccaacgtatgaagaaatggaaaaagcacttcaaaaattagaagaccaatttaatagacaattaagctctacagtagattccttgctacagtcacgatttaatggtgcggtaggattaattaatcattttttaactgctctgaataatttgaaagagattgaaaatgcgatgttaacggctccaaccgatgaaaataaacaattattagaagaaacaaaaagtgttgtgtctgatagatttagagaagttaatacgaatttagcaggtgttgtaccacaatttattgtgcaagggtatgaagaattaagtttacctttatttgcgaaagtagcttcgatgcatcttgtacatttaaaagatggcatattaaatgctactgcttgggggatatcaggggaggaattagcgcagtataaaacagatttttttacacgtagagcggattatgtaaatacgggcactgcagcgtctttacgtgcacggaatagaatattaaacgaacaaggggcaggaggaggtattcatttccaatcaatcatgaaagtagctctatatgatgaaatgtatttatggactttattacaatatgagggaattacacctacggtgtctcgtactattcatcattacattggatatccaactacattaaaacctagcgaaatgaatactttaaatacactgatgacaggagttcccaataaaaaacttagaattatttacggattatattatatgacttctactgcagttccatgggttatgaatggtgtgaaagtgggatatagtggttggcgagatacgctgatagggcgtaatttcttttaccaagggtggggggctcatattggtgatccaaatacatcaccttcaagaaacgtgacagggtggttattaaatacaggtggttctcgttgggaccttcgtattgacgaatcttttattgtaggaaataagtatctagatagttcaaattcgaatcgaattaatatttcgtatgcagatacttcaaaaataggagaagcacattatattcgatcagcggccttaaaaccagctggtgatatctctgggaaacagtattcgttagctgacgatcttgaatatataaatccacgtgaaagtggtgatattataaacaacaatatgattatcggttttgcaccagataatacacgtaattttatgtcaactggtaagcataaattagcatggcatacttcttataccattccagctttgcattatgattatattcttttcaatcctgaagattattatatagactggggttatgtagaggttacaggaacagatggttttctatataaaaaagcaagaccccatgcattgtatccaattagttataaattagacctctcacaaattaatccaaatgaagaatatgtgtgtatcatacgaactgttttaggaagtacatcatataaacttgagcttcctgatactaataacggtttattaaaactagaatttcctgggcgtactttatttaattttcataatcaacttgatttaatttcaacaccgtttaaatttcattcaacctcttcaaatcaaacaatgaatttaataagtgaatatcccgacaaagaagctaagttagtaagtataatgtttattccagcaagtcgatataaaaaacatttt

SEQ ID NO: 116 - protein, 680 aa, Bacillus thuringiensis
MANGNNNNTYNSGNTENNGYMNDNTYNPESANNNEYTNKDLYTSSFIDSNPLSCEDPNLDTCKQNICKGNNGQIGPTVVPVIVAPIVLTPAFIGFGKFLLSSVKDWALEEGLKRVKEWLFPSNNPTYEEMEKALQKLEDQFNRQLSSTVDSLLQSRFNGAVGLINHFLTALNNLKEIENAMLTAPTDENKQLLEETKSVVSDRFREVNTNLAGVVPQFIVQGYEELSLPLFAKVASMHLVHLKDGILNATAWGISGEELAQYKTDFFTRRADYVNTGTAASLRARNRILNEQGAGGGIHFQSIMKVALYDEMYLWTLLQYEGITPTVSRTIHHYIGYPTTLKPSEMNTLNTLMTGVPNKKLRIIYGLYYMTSTAVPWVMNGVKVGYSGWRDTLIGRNFFYQGWGAHIGDPNTSPSRNVTGWLLNTGGSRWDLRIDESFIVGNKYLDSSNSNRINISYADTSKIGEAHYIRSAALKPAGDISGKQYSLADDLEYINPRESGDIINNNMIIGFAPDNTRNFMSTGKHKLAWHTSYTIPALHYDYILFNPEDYYIDWGYVEVTGTDGFLYKKARPHALYPISYKLDLSQINPNEEYVCIIRTVLGSTSYKLELPDTNNGLLKLEFPGRTLFNFHNQLDLISTPFKFHSTSSNQTMNLISEYPDKEAKLVSIMFIPASRYKKHF

SEQ ID NO: 117 - DNA, 1560 bp, Bacillus thuringiensis
atgttaggtgttatgggtgaattgcaaaatatattatacaaaaggagtgggaaaatgaatacacatggaaaaaatgaagagtggaatcagcatcacgatggaacttgtggttgtcaacaaaacaaaccggattatggatatgaacaaatacaagaacatgataagcaacaatatgcatttaatgaatatgaaaaccaagagtatacatatcacaactcttgtggagaaataggaacagatcattacattaaatataatggggattttcaatgtgataccattcgatatactgcacccaatttacctgtagaaagtacgaggtttcagaaaattagaaatgtaaatggtggagatcgagtagttgatgcaaggaatacacctgttggtctgggtcttcaacaaagagtaggtggttgtccatggcaaatagatgttgaaaataccgtagtaaatacagaagctagtcctcagtatcaaacacaagattttattttctatgcaacagatagtggagattttgttattacgaatcaaggaaatggtcgcgttctagaaatggtagaatttccggggagtgatccgcagtggcatcaagttttaatttctagtttctatgagaatagaagaaatcaaatatttactaaacgtgaattaactaatactgattttttactaacgacaacaacagaaacgggtaatgtttttggcataaataattgtaataataatccaaatgtatggcaaatctatacgactgttaatgaaaatgagtctgttggatttcggaataatacgtataaattccaagatgaacgccctctctctttaccatctctacgatctggggaaacgttaaatcctttgccggcattaagatatctacaagattcaggtctaagtccctcagaagcgccaagggcagtaataggaagtgcattacttccagctatatttgtagaagatgtattaccattacctgcaagaatgacacagagtccgtattatgtactagaacatagacaatattggcatagattatggtcagatataataccagctggtggtcaatcttggtttaatgaaacaacagggatgcttggtggagggcctgcacaaacaaatatgaaaaatacgataagcatgtctatcgggcaagatttagggataagattcggaacgcaatcaatgccatttagtattaagattgcagaaaatttaagaagacaaagatcgaatgcaactgcagatataggcgaatctagtcaagaatttcgatatcaaaatcctcaaaatcaacctacaagatttgcaaggtttgcattagcacatgaatatgcgttactaaatatgaatggaagagtgatgaatagatggacagtggtagatagaaatagtatgtatcttttatcatttccacaaaatgcattgttaacaatgcattgcaataaaataatacgtacagataatagttatgatttatcggtgtggaaaacaccgatgcaaataaaaagtgggcaagtgattaccaaaaatgaaaagaattcaaagccctacaatgca

SEQ ID NO: 118 - protein, 520 aa, Bacillus thuringiensis
MLGVMGELQNILYKRSGKMNTHGKNEEWNQHHDGTCGCQQNKPDYGYEQIQEHDKQQYAFNEYENQEYTYHNSCGEIGTDHYIKYNGDFQCDTIRYTAPNLPVESTRFQKIRNVNGGDRVVDARNTPVGLGLQQRVGGCPWQIDVENTVVNTEASPQYQTQDFIFYATDSGDFVITNQGNGRVLEMVEFPGSDPQWHQVLISSFYENRRNQIFTKRELTNTDFLLTTTTETGNVFGINNCNNNPNVWQIYTTVNENESVGFRNNTYKFQDERPLSLPSLRSGETLNPLPALRYLQDSGLSPSEAPRAVIGSALLPAIFVEDVLPLPARMTQSPYYVLEHRQYWHRLWSDIIPAGGQSWFNETTGMLGGGPAQTNMKNTISMSIGQDLGIRFGTQSMPFSIKIAENLRRQRSNATADIGESSQEFRYQNPQNQPTRFARFALAHEYALLNMNGRVMNRWTVVDRNSMYLLSFPQNALLTMHCNKIIRTDNSYDLSVWKTPMQIKSGQVITKNEKNSKPYNA

SEQ ID NO: 119 - DNA, 2253 bp, Bacillus thuringiensis
atgggaggaataaatatgagttcaaattattcaaatgaagacggaatcataaatgcttcaccaagtacttctcaaagatatcctttagtaaaagatccaactgcacaattgaaagatataaattacaaagagtatttacaaaggataagtgaaaatgagattggtattagacctacatcagttggttcaggagcaggttttaatgctgcagcagctattgtggctacattattaggtgttgcaggccatccaggtagttctgcgattgtcaccactcttaatataattattggtttgttatggcctaaaggtgagacggatactattatatgggatgatctcttaaaaatagcagaagaaattgttgatcaggcagtatcggaggcagtattagaagcagcaaatactgcgttagaagaaatgtatagagttgcagaggattatcagcgtacgttagaggattgggtatcaggaagacgtgtagagcaagcatatatgagaggtaaatttgaaaatgcgaaagatatattaaatagtaagatagcgaattttaagaaaccaggctatgaattaccactattaacaatgtatgcacaagccgcaaacttgtatttatatataacgaaagatattacagttttcggaaaagaatgggggtatcttcccgagggtgatccagaagttagtggacagggaactattgattatatttatgagaaagaatttttatatcacatgtctgaacattctgaatattgcgttaaatggtataacgaagggttaaatcgtttaccacgttcttcatttattgattggattgattataatcgttaccgtagagaaatgacattacttgtactagatattatttcgttatttccaagttacgatgcatttgtatatccaatgttgacaaatccagagattacaagagaagtttatacagatcctttagttatgggtagtgattatggtcaagttggttttgcttttgctttcggaaatatagaggaactgactcggaagccacatctgtttgattggttaaattcactaacaatatatacacaagaaatacacgctgctgatgacgtatggaactgttttataaaaggtactaaatcaaaattatcttatacaaatagttcgggtacttttgagttgggaggtacgatgagttccacttatgaagatacttatgacgtaaaatcaaaagatatctatcaaactctattgaatataggttcggattatgaagggacttcttcagagagtagtatgataataggatgcgttgggggtgattttaattatatatcggaaagtggttcaacagggagttttcaccacggacattgcggattaggtagtatggtaacggtagattctttattacaattacctttagaagacgaatccgatgtatcttcttatactcatagactctcctatatgaattttgcttatgatgattattttgaaagtttcagaaaagatcgttcagattatcgttctgtaggtatacaaggttggacacatacaagtgtatctcctgaaaattacattcacagggataaaattacacaattatatggtgttaaaggaaaccatctttctaatgcttctgttgaagtagggcctggatttttaggaggaaatataattaaatgtaatactgatggtggctcttatggcggaagtgtggattttacaattagattggatggtccagacagtgcattccgtattagaattccttatgctgctgaaacagatggcgtatttagtattactattcgagacgagttgagcccttatactatagagcagggttttgtagcaacaatggaccccggagatcctttatcttatgaaaaaattaaatattttgaattcgataaaacgctaaatatgggtgagcgtcatggtgcttttttcgttaaggtaaaagatttaatagatagaagtgctaatgtatattggcataaagttgagattgtcccagtagatgaaaattacgatgagagagtaacactagaaaaagcacagaaagccgtgaatgcattgtttacagcgggaagaaacgcactaccaaaagatgtgacagattttaaagtggatcaggtttccatattagtagattgtgtgtcaggggagttatatccaaatgaaaaacgcgaactactaagtttagtcaaatatacaaaacgtttgagctattctcgtaatttactcctagatccaacatttgat

SEQ ID NO: 120 - protein, 751 aa, Bacillus thuringiensis
MGGINMSSNYSNEDGIINASPSTSQRYPLVKDPTAQLKDINYKEYLQRISENEIGIRPTSVGSGAGFNAAAAIVATLLGVAGHPGSSAIVTTLNIIIGLLWPKGETDTIIWDDLLKIAEEIVDQAVSEAVLEAANTALEEMYRVAEDYQRTLEDWVSGRRVEQAYMRGKFENAKDILNSKIANFKKPGYELPLLTMYAQAANLYLYITKDITVFGKEWGYLPEGDPEVSGQGTIDYIYEKEFLYHMSEHSEYCVKWYNEGLNRLPRSSFIDWIDYNRYRREMTLLVLDIISLFPSYDAFVYPMLTNPEITREVYTDPLVMGSDYGQVGFAFAFGNIEELTRKPHLFDWLNSLTIYTQEIHAADDVWNCFIKGTKSKLSYTNSSGTFELGGTMSSTYEDTYDVKSKDIYQTLLNIGSDYEGTSSESSMIIGCVGGDFNYISESGSTGSFHHGHCGLGSMVTVDSLLQLPLEDESDVSSYTHRLSYMNFAYDDYFESFRKDRSDYRSVGIQGWTHTSVSPENYIHRDKITQLYGVKGNHLSNASVEVGPGFLGGNIIKCNTDGGSYGGSVDFTIRLDGPDSAFRIRIPYAAETDGVFSITIRDELSPYTIEQGFVATMDPGDPLSYEKIKYFEFDKTLNMGERHGAFFVKVKDLIDRSANVYWHKVEIVPVDENYDERVTLEKAQKAVNALFTAGRNALPKDVTDFKVDQVSILVDCVSGELYPNEKRELLSLVKYTKRLSYSRNLLLDPTFD

SEQ ID NO: 121 - DNA, 2145 bp, Bacillus thuringiensis
atgaaactaaagaatcaagataagcatcaaagttattctagcaatgagaaggtagataaaatctctacaaataaaacagatatagaattaaaaaatatggataatgaagattatttgagagtgtctgagcacgagagcattaatccatttgttagtgcatcaacaattcaaacgggtattggaattgctggaaaaatccttggtactctaggtgttccttttgctggacaaatagcaagcctttatagttttatcttgggcgagctttggcctaaagggaaaagccaatgggaaatctttatggaacatgtagaagagattattaatcaaaaaatatcaacttatgcaagaaataaagcacttacagacttgaaaggattaggagatgctttagctgtctaccatgaatcgcttgaaagttgggttgaaaaccgtaataacacacgagcgaggagtgtagtcaagggccaatacatcgcattagaactgatgtttgttcagaaacttccttcttttgcagtatctggtgaggaagtaccattattaccgatatatgtacaagcggcaaatttgcatttgttgctattgagagatgcatctatttttggaaaagaatggggattgtcaccttcggaaatttcaactttttataaccgtcaagtcgatcgaacaagagattattccgaccattgtgtaaaatggtataatacaggcctaaataatttgagaggtacaaatgccgaaagctgggttcgttataatcaatttcgtaaagatatgacattaatggtattagatttaattgcgctattcccaagctatgatacaattgtttatcctattaaaaccacttcacaacttacaagagaagtatatacagacgcaattgggacagtacatccgcatccaagttttacaagtacgacttggtataataataatgcaccttcgttctctgccatagaggctgctgttatccgaagcccacacctacttgattttctagaaaaagttacaatttatagtttattaagtcggtggagtaatactcagtatatgaatatgtggggaggacatagacttgaatcccgcccaataggaggggcattaaatatctcaacacaaggatctaccaatacttctattaatccagtaacattacagttcacgtctcgtgacgtctataggacagaatcatgggcagggctgaatttatttttaactcaacctgttaatggagtacctagagttgatttccattggaaataccccacacttccaatagcatctgataatttttattatctagggtatgctggagttgggacacaattacaagattcagaaaatgaattaccacctgaaacaacaggacagccaaattatgaatcatatagtcatagattatctcatataggactcatttcagcatcccacgtgaaagcattagtatattcttggacgcatagtagtgcaaatcgtacaaatacaattgaggcaaacagcattacacaaataccattagtaaaagcattcaatcttccttcgggtgctactgttgttagagggccaggatttacaggaggggatatccttcgaagaacgaatacgggtacatttggagatatacgagtaactattaatccgccatttgcacaaaggtatcgcgtaaggattcgttatgcttctacaacagatttacaattccatacatcaattaatggaagagctattaatcaagggaatttttcagcaactatgaatagggaagataacttaaactatagaacctttagaactgcgggatttacgactccatttagcttttcagatacacaaagtacattcacaataggtgcttggagcttctcttcaggtaacgaagtttatatagatagaattgaatttgttccggtagaagtagcgcatgaggaaaattatgattttgaaaaagtgcaagaggaggttacagcactgtttacacctactaatcctagaggattaaaaacaaatgtaacggattatgatattgaccaggtattaaatctagtagagtctctatcagatgaattctacgtcgatgaaaagagagaattactcgaaattgttaaatatgcgaagcaacttaatattgaccgtaacatg

SEQ ID NO: 122 - protein, 715 aa, Bacillus thuringiensis
MKLKNQDKHQSYSSNEKVDKISTNKTDIELKNMDNEDYLRVSEHESINPFVSASTIQTGIGIAGKILGTLGVPFAGQIASLYSFILGELWPKGKSQWEIFMEHVEEIINQKISTYARNKALTDLKGLGDALAVYHESLESWVENRNNTRARSVVKGQYIALELMFVQKLPSFAVSGEEVPLLPIYVQAANLHLLLLRDASIFGKEWGLSPSEISTFYNRQVDRTRDYSDHCVKWYNTGLNNLRGTNAESWVRYNQFRKDMTLMVLDLIALFPSYDTIVYPIKTTSQLTREVYTDAIGTVHPHPSFTSTTWYNNNAPSFSAIEAAVIRSPHLLDFLEKVTIYSLLSRWSNTQYMNMWGGHRLESRPIGGALNISTQGSTNTSINPVTLQFTSRDVYRTESWAGLNLFLTQPVNGVPRVDFHWKYPTLPIASDNFYYLGYAGVGTQLQDSENELPPETTGQPNYESYSHRLSHIGLISASHVKALVYSWTHSSANRTNTIEANSITQIPLVKAFNLPSGATVVRGPGFTGGDILRRTNTGTFGDIRVTINPPFAQRYRVRIRYASTTDLQFHTSINGRAINQGNFSATMNREDNLNYRTFRTAGFTTPFSFSDTQSTFTIGAWSFSSGNEVYIDRIEFVPVEVAHEENYDFEKVQEEVTALFTPTNPRGLKTNVTDYDIDQVLNLVESLSDEFYVDEKRELLEIVKYAKQLNIDRNM

SEQ ID NO: 123 - DNA, 1971 bp, Bacillus thuringiensis
atgaattcatatcaaaataaaaatgaatatgagatattggatacttcaccaaacagctctactatgtctactcgttatcctagttacccactagcaaaaaatccacaaatatccatgcaaaatacgaattataaagactggctaaatatgtgtacaaataataacgggattcctatagaacctgtagaccttacctggcaaaatgctcttgttgcagtcttcggtatcgcttcagctgttgcaggattgttagcatctccaattactggcggaacatctatagcagctggagcggctataatagctaatatattaccattaacctttcccgctaatgctgagagtgttccgaataagctaatggatgccacacaagaattacttggccctctagaagaatacactagaaatagagcaaattcggagctactcagtttgagttcacagttagaagcatttaaaggtctatttgattattggctcgctgaccgccaaaatccaaatgcaactaattcagttagtgctcgttttactgcaattcataataattttataggggcaatggctctttttaaaataccgggttatgaagccttactgttaccggtatatgctcaggctgcacgtttacatttgcttcatttaagagacggtatcacgtacgctgatcaatggcagttagctgatccaactaatgcagcttatgcgggagaataccactatagtgaatttaagaaatattctgcgcaatatgcagatcattgtgaagtagtagttaataatcaactaaataagataaaaaatacaaacggtaaaacatggaaagactacaacgaatatcgtcgaaagatgatattatctgttttcgatattgttgctgaattttcaacctttgatccaattttatataaaggagcgataaatagagaaattttaacaaggaaaatatatacagacccagttaatttcacacctggttcttcaattgctaatgatgaaaacaaatatacaatctatcctaccgctgttagacaattggtcgcctcaacactatttactaacgtggtatctgctcagtatgctggatttattggaaataaaaatcgttatttaagtttatcaggtggagagccatttgacggccctctaatcggaaacgatgtattcgaaaaggttttagcaggtgtaccgacagatgaatcgatttatgaagttggtgtaaatggttacccgaatgattatccacgtaatataggtttgagatggggttcgttaactggatttcaaaattattatgctggaggtacgactaatttaggggggatgactacggtctctgtgccacctaaaaataatgccccaataaataatactaattttactcatcgattatcagatataattcttcctggaaatagtggctcatcttttgcatggactcatgttgaaatcaatcctacaggaaactatctatcaacagatcaaattaatttaatatctgctacaaaaacttcatcctattcaaattttaactttatagaaggaccgagatttacaggaggatatttaatcagaaatttgtcaagtacaaggtgccaatcatcttatccgttgaatttaaaacccggtggtagctcaacaagttttagagttcgtatacgttatggatctaatattgctgggaaagtatattttagatttaatggtaaagattcttcacctacttcttttcctagtactaacttcagtactgcttataaatatgatacgtttagagtcgtagagctgcttagtactttacaaaatttcacaggaggtgaattgattattattatagagctagatagtattacgtctttctttgtactagaaagattggaattaattcctatgacagggatgccaacagaatacactgaaccacaaaaattggaaacagcacagaaagcagtaaacgatttatttaccaat

SEQ ID NO: 124 - protein, 657 aa, Bacillus thuringiensis
MNSYQNKNEYEILDTSPNSSTMSTRYPSYPLAKNPQISMQNTNYKDWLNMCTNNNGIPIEPVDLTWQNALVAVFGIASAVAGLLASPITGGTSIAAGAAIIANILPLTFPANAESVPNKLMDATQELLGPLEEYTRNRANSELLSLSSQLEAFKGLFDYWLADRQNPNATNSVSARFTAIHNNFIGAMALFKIPGYEALLLPVYAQAARLHLLHLRDGITYADQWQLADPTNAAYAGEYHYSEFKKYSAQYADHCEVVVNNQLNKIKNTNGKTWKDYNEYRRKMILSVFDIVAEFSTFDPILYKGAINREILTRKIYTDPVNFTPGSSIANDENKYTIYPTAVRQLVASTLFTNVVSAQYAGFIGNKNRYLSLSGGEPFDGPLIGNDVFEKVLAGVPTDESIYEVGVNGYPNDYPRNIGLRWGSLTGFQNYYAGGTTNLGGMTTVSVPPKNNAPINNTNFTHRLSDIILPGNSGSSFAWTHVEINPTGNYLSTDQINLISATKTSSYSNFNFIEGPRFTGGYLIRNLSSTRCQSSYPLNLKPGGSSTSFRVRIRYGSNIAGKVYFRFNGKDSSPTSFPSTNFSTAYKYDTFRVVELLSTLQNFTGGELIIIIELDSITSFFVLERLELIPMTGMPTEYTEPQKLETAQKAVNDLFTN

SEQ ID NO: 125 - DNA, 2040 bp, Bacillus thuringiensis
atgaaaccaaataaccaggataatcatgaaaccttatccaacaaagtgacagtcgaaaaaccttttacagattcactaaaaaatgaaacaactaaaaatagtaattatgaagattgtttgaaaatgtctagacatgaaagcgtagagccgtttgttagtgtatcaacaattcaaacgggaattggtattgctggtaaaatccttggtagcctaggcgttccttttgctgggcaagtagctagcctttatagttttattctaggtgagctttggcctaaggggaaaagtcaatgggaaatctttatggaagatgtagaaaagctagttgatcaaaaaatatcgatttacgcaagaaacaaagcacttgcagatttaaaaggattaggagatgctctggctgtctaccatgaatcccttgaaagttggattgaaaatcgtaataacagaagagctagaagtgttgttaaagaccaatatatcgctttggaacttatgtttgttcagagacttccttcttttgcagtatctggagaagaggtgccgctattaccaatttatgctcaagctgcaaatttacacttattgctattaagagatgcatcaatttttggagaagaatggggtttttcaacttcagaaatttcaacattttataaccgccaatctagtcggacgatagaatattctgactattgctcaggatggtataatacaggactaaatcgcttgagaggtgcaaatgctgaaagttgggtacgatataatcaattccgtagagacatgactttaatggtactagatctagtagcactattcccaagctatgacactcgcacttatccaattaaaacaagtgcccaacttacaagagaagtctatacagatccaaacggtattgtagcaggaggcaataataattggtttagaaatggggcttcgttttccactatagaaaacgcaattattcgacaacctcacctatatgattttctaacgaaccttacaatttacacgagaataagtcgagcaaaccctgcttatatgaatttgtgggcagggcatagaattacttctaatagaataggttctagtaatagtagtgaattggtgtatggggctataactaatccagttagtactactaacttatcatttgtcaatcgggatgtttaccgaactgaatcattagctggtgggcttggcactctgaatggaatactttatggtttaactagagttgattttgatatgatatttcgtaaccgtcctgatatagtaactggattattttatcatccgggacacgcgggcattgcaacccaagtaaaagattcagaaacagaattaccacctgaaacgacagaacagccaaattatagagcatttagtcatctactaagtcatatttcaatgggtccaacgactcaagacgtacctccagtatattcttggacacaccagagtgcagaccgttcaaatacaatcgattcggataggataacacaaataccattggtaaaggcattcaaccttcattcaggcgccactgttgttagaggaccaggatttacaggtggtgatatcttacgaagaactaatcctggtacatttgcagatatgagagtgaatattactggatcttattcccaaagatatcgtgtaaggattcattatgcttctactacaaatttacaattccatacatcaattaacggaagagctattaatcaagggaatttttcagcaactatgaatagtggggggaatttacagtcaggtagctttaggactgcaggttttactactccatttagcttttcagatgcacaaagcacatttacaataagtgcctggagcttctcttcaggtaacgaagtttatatagatcgaattgaatttgttccggcagaagtaacatttgaagcagaatatgatctagaaagagcgcagaaggcggtgaatgccctgtttacttctacaaatccaagaggattaaaaacagatgtaacggattatcatatcgaccaagtatccaatcta

SEQ ID NO: 126 - protein, 680 aa, Bacillus thuringiensis
MKPNNQDNHETLSNKVTVEKPFTDSLKNETTKNSNYEDCLKMSRHESVEPFVSVSTIQTGIGIAGKILGSLGVPFAGQVASLYSFILGELWPKGKSQWEIFMEDVEKLVDQKISIYARNKALADLKGLGDALAVYHESLESWIENRNNRRARSVVKDQYIALELMFVQRLPSFAVSGEEVPLLPIYAQAANLHLLLLRDASIFGEEWGFSTSEISTFYNRQSSRTIEYSDYCSGWYNTGLNRLRGANAESWVRYNQFRRDMTLMVLDLVALFPSYDTRTYPIKTSAQLTREVYTDPNGIVAGGNNNWFRNGASFSTIENAIIRQPHLYDFLTNLTIYTRISRANPAYMNLWAGHRITSNRIGSSNSSELVYGAITNPVSTTNLSFVNRDVYRTESLAGGLGTLNGILYGLTRVDFDMIFRNRPDIVTGLFYHPGHAGIATQVKDSETELPPETTEQPNYRAFSHLLSHISMGPTTQDVPPVYSWTHQSADRSNTIDSDRITQIPLVKAFNLHSGATVVRGPGFTGGDILRRTNPGTFADMRVNITGSYSQRYRVRIHYASTTNLQFHTSINGRAINQGNFSATMNSGGNLQSGSFRTAGFTTPFSFSDAQSTFTISAWSFSSGNEVYIDRIEFVPAEVTFEAEYDLERAQKAVNALFTSTNPRGLKTDVTDYHIDQVSNL

SEQ ID NO: 127 - DNA, 1065 bp, Bacillus thuringiensis
atggtgaaaagagatatttcagctagggatcttggcggtaaggaggattctccttttttattaaaaaaagaagaatggattaaaattcaaaaatacacaggtgatggtgcatatttacctgtaaatgttactgagatgcgcaaagttttagcattggaaaactcagcaacactacctgattttcaagaattgtatactgttaatacgaatattaaaggccattgtaaaaattggacagataatacctacagagaagttcttactgttgcgaatgagattgttaattatgcaagaagagcaagtgtttattatgcacccttacttgaatatttaccggatattttaaatggtgatactgaggccttagaaaagttcaagaaaatttgtggtaagttagcgaatgaagcgaaggattttagtgaccatgctaaaactttagctgatgacgttggaaagttcgctacagatacctcaactgattacacaaacttagtaacagttaaagcaaaatatgataagttgtatggcgaacagagcgaagatgtaaaactacttagggctgaagtagagcagttgcggaaagatttagaggaatatatggaagattatgaggaatatcaatctcaatcttggttgtctttgttacttggtcctgtttttggttttgtgttaaagggaattctcgacagtacgaaagggaaaatgttacaagctaaaattgaagctacaaaacaaaaaatcgaagcaaatgatgaaataatacagcgaaatgtttacttaatggctttactcgataaagcagataaaggaacagacaagactcaaaaacaaattgaggatgcgcttcctgtgattcaaaaaatccaaggtatttggaattctcttcacagtgaccttttggaactttcgataattacgatggaagatattcaaaatgatccggaatttgccgatcttggaatcgaattagcaattttacaatgggaagctgtaggcaaacaagcagatgatttccgagttaatgcagatgttggatttatagttgatcaatattttgcatcagca

SEQ ID NO: 128 - protein, 355 aa, Bacillus thuringiensis
MVKRDISARDLGGKEDSPFLLKKEEWIKIQKYTGDGAYLPVNVTEMRKVLALENSATLPDFQELYTVNTNIKGHCKNWTDNTYREVLTVANEIVNYARRASVYYAPLLEYLPDILNGDTEALEKFKKICGKLANEAKDFSDHAKTLADDVGKFATDTSTDYTNLVTVKAKYDKLYGEQSEDVKLLRAEVEQLRKDLEEYMEDYEEYQSQSWLSLLLGPVFGFVLKGILDSTKGKMLQAKIEATKQKIEANDEIIQRNVYLMALLDKADKGTDKTQKQIEDALPVIQKIQGIWNSLHSDLLELSIITMEDIQNDPEFADLGIELAILQWEAVGKQADDFRVNADVGFIVDQYFASA

SEQ ID NO: 129 - DNA, 2520 bp, Bacillus thuringiensis
atgaatacagatcaaaatagaaatgaatatgaaatactggatgcttcaacccatcatgagtacatatcaaacagatatcctttcgcaaagaatcccaacgttatgcaaggtaccaattataaagattggttcaatgagtatcaagatattgctccttcttctcttgtaagtactctagtcaccatgtttaatctctttaaacaattcattactttcattgagacgcctaacgtttccctaagggagattataggcgcattgcggagtcgtcaagtaataaatcttactataaatgatgtacaacgacttattgatacagcattaaaaatcacatcagaattgaggcaagtcaaaaatttgatagtatacaattataatcaatatctttccaataaaagtaactatataaataatccatcgaatcctaaccgaaacctatttgtaaatagtcttattttaaatgagcgtgatttgagaatagcactagatgttcatttagcaatattaaaagatgctgtaatatttaggggaccagacttaatagcgcctgcgattattgaaacacctgagaatccttttttgaatcgacctcctagtaattcttatgaattggcgcttttaactagcatacgtatgtattctaattattgcgtaagacactataatgaaggtttaaatcgcataagaaacaggggtacatttagtaatgtttggttggatttccataattatcgcagagaaatgacattaatagtattagattttgtcgcattgttctcactttttgacacaactaaatatccaatattaggaagttctacaccgccagtagtttctcaattaagtagggtaatttataccgatccggtaggtgctataagaaccgatggtcgggggtggtttgatccacccgtaggaactgataggattagagtcaattttgcatcaatagaaaatgaacaaaccggccctactacttctcggcatttatcggaattaacaatttcttcagggccgcttggttttggcataaatccaagtaggacacattcgtggcagggtaatcgaaatgttaatatatccgctcctacggatgtttctggagtaatttctaatcggacgcaaactattcctgctagaaatattttcagagtgaattcacgtgtttatactcttgattggaggttgtatggagtttatagagctgaattttttcaggatgctagtcaaaattctcaaatacgtgtatttgcagaaaatcctccaacaggtgctggtgcccaaagcgcaaataacttccgatttttacctggagaaaattcggatacaccaactccgcaggattatacccatttattaagtagagtagtaaatgcaactgtaggacttacaccggcaacaggaaatcaacgtaattctgtattgatatttggttggaaacataagagtttaacctctgaaaatatatatagaatcaacgaaattacgcaagtagctgctgtgaatacaagaaataatttgggtattcgggtaatttcaggacctggatttacaggtggagatttagtaagaatggattctaacggtagcgtaagttacaattttacacccgctaatcagcaagccttgcaatcaagtgttgcaattcgtttacgttatgcttgtcaaggggaagcatcattaagaataacatttggtaatggttctagccaagtaattccacttgtctctacaacttcatcactaaatgatcttcaatatgaaagttttcgtttcgctaatgttccaaataacgttagttttcaaacattcggaacttcaatgactattcaaaatataagtgcgaattctaacgtagttctagatagggttgaacttttttccaacatacctatacccattctcgaagatacttataacctaggctcaaatagccagtatagccaacactataatgattcttataaccacagcacgaacagcccgtataaccaaatttatgatgattcttataaccacagcacgcatagcccgtataaccaagactatgatgattcttataaccaaaacacgcataaccagtatagtcaagactatgatgattcttataaccacagcacgcatagcccgtataaccaagactatgatgattcttataaccaaaacacgcataaccagtatagtcaagactatgatgattcttataaccaaaacgcgcatagtcagtatagtcaagactatgatgattcttataaccacagcacgcatagcccgtataaccaagactatgatgattcttataaccaaaacacgcataaccagtatagtcaagactatgatgattcttataaccacagcacgcatagcccgtataaccaaatttatgatgattcttataaccaaagtacgcataaccggtatagccaacactataataataatttaaatcacaatagtccgtgtgatcctagctttaatcattattacaatcaaaatgttcataaaaactgtaattgtaaa

SEQ ID NO: 130 - protein, 840 aa, Bacillus thuringiensis
MNTDQNRNEYEILDASTHHEYISNRYPFAKNPNVMQGTNYKDWFNEYQDIAPSSLVSTLVTMFNLFKQFITFIETPNVSLREIIGALRSRQVINLTINDVQRLIDTALKITSELRQVKNLIVYNYNQYLSNKSNYINNPSNPNRNLFVNSLILNERDLRIALDVHLAILKDAVIFRGPDLIAPAIIETPENPFLNRPPSNSYELALLTSIRMYSNYCVRHYNEGLNRIRNRGTFSNVWLDFHNYRREMTLIVLDFVALFSLFDTTKYPILGSSTPPVVSQLSRVIYTDPVGAIRTDGRGWFDPPVGTDRIRVNFASIENEQTGPTTSRHLSELTISSGPLGFGINPSRTHSWQGNRNVNISAPTDVSGVISNRTQTIPARNIFRVNSRVYTLDWRLYGVYRAEFFQDASQNSQIRVFAENPPTGAGAQSANNFRFLPGENSDTPTPQDYTHLLSRVVNATVGLTPATGNQRNSVLIFGWKHKSLTSENIYRINEITQVAAVNTRNNLGIRVISGPGFTGGDLVRMDSNGSVSYNFTPANQQALQSSVAIRLRYACQGEASLRITFGNGSSQVIPLVSTTSSLNDLQYESFRFANVPNNVSFQTFGTSMTIQNISANSNVVLDRVELFSNIPIPILEDTYNLGSNSQYSQHYNDSYNHSTNSPYNQIYDDSYNHSTHSPYNQDYDDSYNQNTHNQYSQDYDDSYNHSTHSPYNQDYDDSYNQNTHNQYSQDYDDSYNQNAHSQYSQDYDDSYNHSTHSPYNQDYDDSYNQNTHNQYSQDYDDSYNHSTHSPYNQIYDDSYNQSTHNRYSQHYNNNLNHNSPCDPSFNHYYNQNVHKNCNCK

SEQ ID NO: 131 - DNA, 2238 bp, Bacillus thuringiensis
atggcaactttaaatgagctttatcctgtgccttataatgttttatcttcgagacacgttaattcctggcctaatactgtttcaaaagctcaagacacaccttatgattatgaacaattgctaaataattttgggaaaagtatacaagatggaagctatgaaaaagaaattgtttccatctttcaagcagttatagatcaaaaaataaactatcaaacctttattcttcttggactgcaaactgtttcactagcagttcctgaaatcggtgtcttaactccatttgtcagtttatttttttcagcaatcaataaacacaatgacgacgttccgcccctaacccctaaaagcatttttgaggctattaaacctgcaattgaagaaatgattgagcgagcactattgacgcaagaacagacttatttagaaaatctaattaagggattagagagtttgatgcaaaagtatcacaatcagatgaacaatattcaagaaatcggaggtttttccaaagcaactgcgggacaaattaaacttttcgaggatgatctaaccgctttagataactattttacaacaatgttgcctcaatttacaaattcaagggaccctgtgaatggagagtacaatgctgaatttactctgattggtcttccttattattgtattttggcttgtatgcatctcatgttgtatagagatattatttctaatggtaaaaattggattccgagtaagtacgatgaaggttctattcgcgacatacaaaaggaactacaaacgaatattaaaaactattctaacacagttcggacagtttttaataacgtgctgaattcgcctaaatataataacggcgatttagcacctacagataaaactactttttcaaagcaaaaagcattcattgaaggaatgacaataaattgttttgatttcgctatgctattccccacatttgacagatctgtctattcacaagaaacaacgttagaaaaaacaaggttaataatatctccaatactagatgtgactgggttatctatccccttagatttttcaaactggcctgattttcaaaatggacttatgccctacaaaggtagagagatgacacaaatagatgtatatggtaattttaaacattcttcgtttgagatgattagtaatatgacgatagctgacaattacgaaactagaagttatggcgaccaagcattaagttcagatgatcatacaaaggtttcaatatcttcagatgatccattggtatactttaattcaaatgcaaacttaggtcctcttccagattatggtggatcttttgggtttcaatctggaaaaatggtatcttatggagctgatcgggaaacaactgatggccaatacgctgctcctagtaatcataaaatttcatatatttatccatttcttaatactaatcttaatgctgcgagattttcatattacgcagttgtaagtatgccaaaggatttatctttaacaaacataataggagacattgattctgataccaaacaaccatctacacaaatcaaaggatttccatttgaaaaatattctacgtttactgatcaatttagtaatccttataatatcgtcgttcgtaaggaatggataaatggggctaatgctatacaagttgatggtcaacaagctatcgcaatgaatgtaactaatattacaccgcaaaagtataaaattcgtttacgctacacaacacagaatggtgcgaatgcggacatttggttccatatcataaattcttttaatcaagacatcacaaatggagtggctaatttgatacctataggctcagcagttcctataaaaggggaaatgggagattacgtgttaagagaaatagacggagaatttgctttatctgccggtacaaataaaataatagttcaaaatagggattctgatcatctgctctttttagaccgtattgaattcatgcccatagtttctgataatggtggcaatggtggcaatggtggcaatggcggtaatggtggcaatggcggtaatggtggcaatggcggtaatggtggcaatggcggtgatggtggcaatggcggtgatggcggtgatttctgtccatttggacaaataggaatttgctttactgaacaaagtgatttacaaaacatcacaacgcaagtcaatgccctattcgcttccagcgcacaagatgctctcgcgacaagtgtc

SEQ ID NO: 132 - protein, 746 aa, Bacillus thuringiensis
MATLNELYPVPYNVLSSRHVNSWPNTVSKAQDTPYDYEQLLNNFGKSIQDGSYEKEIVSIFQAVIDQKINYQTFILLGLQTVSLAVPEIGVLTPFVSLFFSAINKHNDDVPPLTPKSIFEAIKPAIEEMIERALLTQEQTYLENLIKGLESLMQKYHNQMNNIQEIGGFSKATAGQIKLFEDDLTALDNYFTTMLPQFTNSRDPVNGEYNAEFTLIGLPYYCILACMHLMLYRDIISNGKNWIPSKYDEGSIRDIQKELQTNIKNYSNTVRTVFNNVLNSPKYNNGDLAPTDKTTFSKQKAFIEGMTINCFDFAMLFPTFDRSVYSQETTLEKTRLIISPILDVTGLSIPLDFSNWPDFQNGLMPYKGREMTQIDVYGNFKHSSFEMISNMTIADNYETRSYGDQALSSDDHTKVSISSDDPLVYFNSNANLGPLPDYGGSFGFQSGKMVSYGADRETTDGQYAAPSNHKISYIYPFLNTNLNAARFSYYAVVSMPKDLSLTNIIGDIDSDTKQPSTQIKGFPFEKYSTFTDQFSNPYNIVVRKEWINGANAIQVDGQQAIAMNVTNITPQKYKIRLRYTTQNGANADIWFHIINSFNQDITNGVANLIPIGSAVPIKGEMGDYVLREIDGEFALSAGTNKIIVQNRDSDHLLFLDRIEFMPIVSDNGGNGGNGGNGGNGGNGGNGGNGGNGGNGGDGGNGGDGGDFCPFGQIGICFTEQSDLQNITTQVNALFASSAQDALATSV

SEQ ID NO: 133 - DNA, 2088 bp, Bacillus thuringiensis
atgaatactgtattgaataacggaagaaatactacttgtcatgcacataatgtagttgctcatgatccatttagttttgaacataaatcattaaataccatagaaaaagaatggaaagaatggaaaagaactgatcatagtttatatgtagcccctattgtgggaactgtgggtagttttctattaaagaaagtagggagtcttgttggaaaaaggatactgagtgagttacagaatttaatttttcctagtggtagtatagatttaatgcaagagattttaagagcgacagaacaattcataaatcaaaggcttaatgcagacacccttggtcgtgtaaatgcagaattggcaggtcttcaagcgaatgtggcagagtttaatcgacaagtagataattttttaaaccctaatcaaaaccctgttcctttagcaataattgattcagttaatacattgcagcaattatttctaagtagattaccacagttccagatacaaggctatcaactgttattattacgtttatttgcggaattggcagggctgcaagcaaatgtagaagagtttaatcgacaagtagataattttttgaaccctaaccgaaacgctgttcctttatcaataacttcttcagttaatacaatgcaacaattatttctaaatagattaccccagttccagatgcaaggataccaactgttattattacctttatttgcacaggcagccaatttacatctttcttttattagagatgttattcttaatgcagatgaatggggcatttcagcagcaacattacgtacgtatcgagattacttgagaaattttacaagagattactctaattattgtataaatacgtatcaaagtgcgtttagaggtttaaacactcgtttacacgatatgttagaatttagaacatatatgtttttaaatgtatttgaatatgtatctatctggtcgttgtttaaatatcaaagtcttctagtatcttccggtgctaatttatatgcaagtggtagtggaccacagcagacccaatcatttacttcacaagactggccatttttatattctcttttccaagttaattcaaattatgtgttaaatggatttagtggtgctaggctttctaataccttccctaatatagttggtttacctggttctactacaactcacgcattgcttgctgcaagggttaattacagtggaggaatttcgtctggtgatataggtgcatctccgtttaatcaaaattttaattgtagcacatttctccccccattgttaacgccatttgttaggagttggctagattcaggttcagatcgggagggcgttgccaccgttacaaattggcaaacagaatcctttgagacaactttagggttaaggagtggtgcttttacagctcgcggtatttcaaactatttcccagattattttattcgtaatatttctggagttcctttagttgttagaaatgaagatttaagaagaccgttacactataatgaaataagaaatatagcaagtccttcaggaacacctggtggagcacgagcttatatggtatctgtgcataacagaaaaaataatatccatgccgttcatgaaaatggttctatgattcatttagcgccaaatgactatacaggatttactatttcgccgatacatgcaactcaagtgaataatcaaacacgaacatttatttctgaaaaatttggaaatcaaggtgattccttaaggtttgaacaaaataacacgacagctcgttatacgcttagagggaatggaaatagttacaatctttatttaagagtttcttcaataggaaattccactattcgagttactataaacggtagggtatatactgctacaaatgttaatactactacaaataacgatggagttaatgataacggagctcgtttttcagatattaatatcggtaatgtagtagcaagtagtaattctgatgtaccattagatataaatgtaacattaaactccggtactcaatttgatcttatgaatattatgcttgtaccaactaatatttcaccactttat

SEQ ID NO: 134 - protein, 696 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLRLFAELAGLQANVEEFNRQVDNFLNPNRNAVPLSITSSVNTMQQLFLNRLPQFQMQGYQLLLLPLFAQAANLHLSFIRDVILNADEWGISAATLRTYRDYLRNFTRDYSNYCINTYQSAFRGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 135 - DNA, 2013 bp, Bacillus thuringiensis
atggagattaataatcagaaccaatgtgtcccttataattgtttgaataatcctgaaagcgagatattaaacgttgcaatttttagtagcgaacaggtagcagaaattcacttaaagatcacgcgcttaattttagagaattttttaccaggtgggagttttgcattcggcttatttgatttaatatgggggatttttaatgaagatcaatggagcgcatttcttcggcaggtagaagaattaattaatcaaaggataacggaattcgcaagagggcaagcaattcagagacttgtagggtttggaaggagttatgatgaatatattttagcactaaaagaatgggaaaacgatcctgataacccagcttcaaaggaaagagtgcgcactcgatttcggacaactgatgatgccttgctaaccggtgttcctcttatggcaattccaggttttgaattagctactttatctgtttatgctcaatcagccaatctacatttagccctattaagagatgctgtattttttggggagagatggggattgacacaaacaaatataaatgatttatatagtagattaaaaaactccattcgtgattatacaaatcattgtgttcgtttttataatataggtttagggaatttaaatgttataagaccagagtattaccgtttccaaagagaattaacaatatctgtcttagatcttgtagctctttttccaaattacgatatccgaacatatccaataccaactaaaagtcaattaacaagagaaatttatacagatccgattatttcacctggtgcacaggcaggttatactcttcaagatgttttgagagaaccacaccttatggactttttaaaccgacttattatttatactggtgagtatcgcggaattcgtcactgggcaggacatgaagtagaatctagtagaacaggtatgatgactaatataagatttcctttgtatggaacagccgcaacagcagaaccaacacgatttataactcctagtacttttcctggtcttaatttattttatagaacattatcagctcctatttttagagatgaaccgggagctaatattattattagatatagaacgagtttggtggaaggagtaggatttattcaaccaaataacggtgaacagctttacagagtgagaggaacattagattctcttgatcaattaccacttgagggtgagagtagtctaactgaatatagtcatcgattatgccatgttagatttgcgcaatcattgaggaatgcagaacctttagattatgcaagggttccgatgttttcttggacacatcgtagtgcaacccctacaaatacaattgatccagatgtcatcacccaaataccgttagtaaaggctttcaatcttcattcaggtgccacggttgttagaggaccaggatttacaggtggggatatccttcgaagaacgaatactggtacatttggggatatacgagtaaatattaatccaccatttgcacaaagatatcgcgtgaggattcgctatgcttctactacagatttacaattccatacgtcaattaacggtaaagctattaatcaaggtaatttttcagcaactatgaatagaggagaggacttagactataaaacctttagaactgtaggctttaccactccatttagcttttcagatgtacaaagtacattcacaataggtgcttggaacttctcttcaggtaacgaagtttatatagatcgaattgaatttgttccggtagaagtaacttatgaggcagaatatgattttgaaaaagcgcaagagaaggttactgcactgtttacatctacgaatccaagaggattaaaaacagatgtaaaggattatcatattgaccaggtatcaaatttagtagagtctctatcagatgaattctatcttgatgaaaagagagaattattcgagatagttaaatacgcgaagcaaatccatattgagcgtaacatg

SEQ ID NO: 136 - protein, 671 aa, Bacillus thuringiensis
MEINNQNQCVPYNCLNNPESEILNVAIFSSEQVAEIHLKITRLILENFLPGGSFAFGLFDLIWGIFNEDQWSAFLRQVEELINQRITEFARGQAIQRLVGFGRSYDEYILALKEWENDPDNPASKERVRTRFRTTDDALLTGVPLMAIPGFELATLSVYAQSANLHLALLRDAVFFGERWGLTQTNINDLYSRLKNSIRDYTNHCVRFYNIGLGNLNVIRPEYYRFQRELTISVLDLVALFPNYDIRTYPIPTKSQLTREIYTDPIISPGAQAGYTLQDVLREPHLMDFLNRLIIYTGEYRGIRHWAGHEVESSRTGMMTNIRFPLYGTAATAEPTRFITPSTFPGLNLFYRTLSAPIFRDEPGANIIIRYRTSLVEGVGFIQPNNGEQLYRVRGTLDSLDQLPLEGESSLTEYSHRLCHVRFAQSLRNAEPLDYARVPMFSWTHRSATPTNTIDPDVITQIPLVKAFNLHSGATVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 137 - DNA, 378 bp, Bacillus thuringiensis
atgacagtatataatgcaactttcaacattaatttctataatgaaggggaatggggggggccggaaccttatggttatataaaagcatatcttacaaatccagatcatgattttgaagtttggaaacaagatgattggggggaaagtacacctgaaagaaattcttatacgcaaaccattaaaataagtagcgatactggttcccctataacccaaatgtgtttttatggtgatgtgaaagaatacgatgtcggaaatgcagatgatattcttgcttatccaagtcaaaaagtatgcagtacacctggtgtaacagtacgacttgatggagatgagaaaggttcttatgtaacaattaaatattccttgactccagca

SEQ ID NO: 138 - protein, 126 aa, Bacillus thuringiensis
MTVYNATFNINFYNEGEWGGPEPYGYIKAYLTNPDHDFEVWKQDDWGESTPERNSYTQTIKISSDTGSPITQMCFYGDVKEYDVGNADDILAYPSQKVCSTPGVTVRLDGDEKGSYVTIKYSLTPA

SEQ ID NO: 139 - DNA, 1638 bp, Bacillus thuringiensis
atgactaaaaggaaaaaatacatgagatttggcttgttcatattcagttgttcagttgttttgttcgtcagcggctgtaaaacacaacaaacagaagatccatcaacagctggccctacttcaagcaaaatgaaacaggcaatcagcatggagacaccagaggagagctatttcaaaaaagaaaacaattcttctcatttgtttgagtttgcttctcaatttagaaaaccactggatcttcccacggaagcaatgatcaaggatgaaaccaatcagctgagaatcgcttaccttgaagccacaacagtctctcaaaatcgggaaaatacagaatcaagaagcaatctcacgaatcgcttcgaagaaaacgaacaaaaaggtactctatccaatatttcagcaattccagagagcgataatcattggcaaggtccttacgtccatgcaaatgctccattgcagatcttaccaagaggaacagcaattgatccctttacctattttactgttgttcaaggaagtgatcccgttccagtgatccattatacgcccgtcgatcctaatgaatctggctaccaagtgatgcagatcacagcaattgattcaaaagggaaagtgagtgttgcgacagtcacctttctgtttaatcactctccgatcattcagcaagtaagacaaagtcaccacatcacgattggttcaagtattgacttattagcgggcatttctgctcatgatgaagaagatggtgaattgacctcagaagttcaagtacaaaccacactccaaacagaacaagaaggcagttatgaagtgatttattctgtgactgatcaatttggagcaagtaccaagctgataagtaatatgaggatcaccaatgaagcaccaataatcgcggggccgaaccagctcgttttacctgttgatcaatcattctctttatttgattatttctccgcaaatgatcaagaagatggtgcgatcaaccttacttcagacaatatcttggcatccgatcttgtcccttatgtaccaggaaactacttcgtaagaattgggaatgtcgttgatcggtatggcaaaagagcggcagagcgtacgatccgtgttcacttaacaaatgaagcgccgacgattacaaatacgcacatgactcttcctgtatttagtgaactgaataaagaaagctatctagcaaaacttgttcttgcagatcgtgaagatccggttgagcaattacatgtggcaatcgatctgcctttttgggagaaaatcgacacttcccgattaaatacctatcgttttcctcttcaagtccaagatacacatggagagatcaccaaaacctttgggagcatccaagtaatcaatgaaccacctgtattttctgggatagaggataagagaatcattgtaggcgaagaaaagccagatttattagcagggatctccgtttcggatcgtgaagagagtattggaatagaagatgttgagatcatagaagaaatcgcttgggatacacctggaagctatcctgtttatttgacggtcaaagatacatttacagaaacgacagtatcttttcatgtcattattcaagacaacaatccagaaatgccagagaaattgagcgaa

SEQ ID NO: 140 - protein, 546 aa, Bacillus thuringiensis
MTKRKKYMRFGLFIFSCSVVLFVSGCKTQQTEDPSTAGPTSSKMKQAISMETPEESYFKKENNSSHLFEFASQFRKPLDLPTEAMIKDETNQLRIAYLEATTVSQNRENTESRSNLTNRFEENEQKGTLSNISAIPESDNHWQGPYVHANAPLQILPRGTAIDPFTYFTVVQGSDPVPVIHYTPVDPNESGYQVMQITAIDSKGKVSVATVTFLFNHSPIIQQVRQSHHITIGSSIDLLAGISAHDEEDGELTSEVQVQTTLQTEQEGSYEVIYSVTDQFGASTKLISNMRITNEAPIIAGPNQLVLPVDQSFSLFDYFSANDQEDGAINLTSDNILASDLVPYVPGNYFVRIGNVVDRYGKRAAERTIRVHLTNEAPTITNTHMTLPVFSELNKESYLAKLVLADREDPVEQLHVAIDLPFWEKIDTSRLNTYRFPLQVQDTHGEITKTFGSIQVINEPPVFSGIEDKRIIVGEEKPDLLAGISVSDREESIGIEDVEIIEEIAWDTPGSYPVYLTVKDTFTETTVSFHVIIQDNNPEMPEKLSE

SEQ ID NO: 141 - DNA, 1710 bp, Bacillus thuringiensis
atgtttacaagtagtacgaaaaattcgttgaaaatagaaacgacagattatgaaatagatcaagtagccaattcgatagaatttatgccagatgaacaaaattccccaaaaaaaatgatgttatgggatgaagtaaaacaggcaaaacaacttagtcagtctcgtaatttactccaaaatggagactttggaggtttaactggaaataattggatacttaaaaatgatattatcatagaatccaatgatcctatttttaaagggaagtttcttcagatgcgtggagcacgagacatatatggaaccatatttccaacttatatctatcaaaaaatagaggaatccaaattaagaccctatacacgttatcgagtaagagggtttgtgggaagtagtaaaggtttgaaattaatggtaacacgttactggaaagaaattgataccattatggatgttcccaatgatttggcctatatgcagcttatcccttcatgtggagattatcgctgtgaatcatcatcccagtatatgggccaagggtattctaaaccagcaacagatggatatacttctgataggtatgcttgcccgtcaaattcaggtgaaaaacatgttatgtgtcacgatcgtcatccatttgattttcgtattgacactggagaattagatacaaatacaaacgtaggaattgatgttttatttaaaatatctaatccagatggatacgctacattagggaatttagaagtcattgaagaaggaccactaacagacgaagcattggcacatgtgaaacataaggaaaagaaatggaatcaacacctggagaaaaagcgaatggaaacacaacaggcctatgatccagcaaaacaagcattaggtgcattattcacaaatgcacaaggtgaagagttacactatcatactactttaaatcatattcaaaacgctgatcggctggtacagtcgattccttatgtataccatgattggttaccggatgctccaggtatgaactatgatttatataacaattcaaagtcacgtatagaacaagcacgctatttatatgatgcacgaaatgtcatcacaaatggtgactttacacaaggactaacgggatggcacgcaacaggaaaggcaacggtacaaaaactggatggagcttctgtattagttctgtcaaactggagtgctggggtatctcagaatctccatgcccaagatcatcatggatatatgttacgtgtgattgccaaaaaagaaggacctggaaaagggtatgtaacgatgatggattgtaacggcaatcaggaaacgctgaagttcacttcttgtgaagaaggatatatgacaaaaacagtagaggtattcccagaaggcgaccgtgtacggattgaaatgggagaaaccgaaggtacattttatatacaaagcattgagttgctttgtatgaaagggtatactagcaataataatccgcacacgggtaatatgtatgagcaaagttataatggaaattataatcaaaatactagcgatgtgtatcaccaagggtatacaaacaactataaacaagactctagtaatatgtataatcaaaattatactaacaatgataacctgcattccggttgtacgtgtaaccaaggtcataacaataatgataaccaaaactctggctgtacatgtaatcaaggatataaccgt

SEQ ID NO: 142 - protein, 570 aa, Bacillus thuringiensis
MFTSSTKNSLKIETTDYEIDQVANSIEFMPDEQNSPKKMMLWDEVKQAKQLSQSRNLLQNGDFGGLTGNNWILKNDIIIESNDPIFKGKFLQMRGARDIYGTIFPTYIYQKIEESKLRPYTRYRVRGFVGSSKGLKLMVTRYWKEIDTIMDVPNDLAYMQLIPSCGDYRCESSSQYMGQGYSKPATDGYTSDRYACPSNSGEKHVMCHDRHPFDFRIDTGELDTNTNVGIDVLFKISNPDGYATLGNLEVIEEGPLTDEALAHVKHKEKKWNQHLEKKRMETQQAYDPAKQALGALFTNAQGEELHYHTTLNHIQNADRLVQSIPYVYHDWLPDAPGMNYDLYNNSKSRIEQARYLYDARNVITNGDFTQGLTGWHATGKATVQKLDGASVLVLSNWSAGVSQNLHAQDHHGYMLRVIAKKEGPGKGYVTMMDCNGNQETLKFTSCEEGYMTKTVEVFPEGDRVRIEMGETEGTFYIQSIELLCMKGYTSNNNPHTGNMYEQSYNGNYNQNTSDVYHQGYTNNYKQDSSNMYNQNYTNNDNLHSGCTCNQGHNNNDNQNSGCTCNQGYNR

SEQ ID NO: 143 - DNA, 1737 bp, Bacillus thuringiensis
atgtatgcattatgttttgaaaaacagataaaacacctattaaaaaattatcaagtaagaattcgttatgcttcaaaaggcataaattcattaatagtacggggggattggctttcttatgctaaacaatctacagaagatacatttcaagatactcaactttctaatttaacatacgaaaatttccaatatataaatataaataccagaataaatataaatgatataacaacaagggattttcattatatatttttagaaaatcaaaccttaactcctaataatatgcttattattgataaaatcgaaattattccaataactcaacaatacctagaaacaagtgaaaaagaaaaagtagaaacagttcaaaaaagcatcaacaatttatttattaatcaacaaaaacaatatttaaaaacagaaacgacggattatgaaatagatcaagtggcaatttctataaaatgtatgtcagataaacagcaatatacccaagaaaatatgctttggtgggatgaagtgaaacatgccaaatatctcagtcattctcgtaatctacttcaaaatggtgattttgaagatgtatttaatggctggactacaagtaaaaatatattcattcacacagataattcaacttttaaaggaaaatatctacacatgtatggagcgcgggatattgacggaactttattcccaacatatatataccagaaaattgacgaatcaaaattaaaaccgtatacacgttatcaaataagaggatttgtgggaagtagtaaggagctaaaattaatggtaattcgttatggaaaagaaatagataccatcatgaatgtaccaaatgatataccatacgtaccttctatgctttcttgtaatgaattatacaacagtgaacaatcactgtaccagaagagaaatgttgactattacaatcagatgccagagtatacatttaacacttatcagtgtataccagaccaaaaacaagcaatctgtcatgattctcatcaattcaagtttcatattgatataggtgaagtggattacaatacaaatttaggaatgttagttttatttaaaatttcttcacctgatggttacgcaacattagggaatctagaagttattgaagaaggacctataacaggagaagcattagtacttgtaaaacaaaaggaaaagaaatggaatcaacacatggagaaaaagcgaatggacacaaagcaagcctatgaccgagcaaaggaggcggtagatgcattatttacaggagaagagttaaactataatgttacattgtctcagattaagaacgctgatcagttggttcagtcgattccgtatatacacaacatacaaggattacaaggatggcacgcagaagggaaagtagaaatacagcaaatgaatagaatgtctgtattagtcttatccaattggagttctggagtatctcaaaacctgcatgtgcaacatcaacatggatatgtgttacgtgtgagtgcgaaaaaagaaggacctggaaaagggtatgttacgatgatgggttgtaatggaaggcaggaaacacttatgtttacgccctgtgacggaggatatatgacaaaaactttagaggtattcctagatacggatcgtatacgaatagaaattggagaaaccgaaggttcgttttatatagaaagtatagagttgaattgtgtgaaaggctataacaatgaatacaat

SEQ ID NO: 144 - protein, 579 aa, Bacillus thuringiensis
MYALCFEKQIKHLLKNYQVRIRYASKGINSLIVRGDWLSYAKQSTEDTFQDTQLSNLTYENFQYININTRININDITTRDFHYIFLENQTLTPNNMLIIDKIEIIPITQQYLETSEKEKVETVQKSINNLFINQQKQYLKTETTDYEIDQVAISIKCMSDKQQYTQENMLWWDEVKHAKYLSHSRNLLQNGDFEDVFNGWTTSKNIFIHTDNSTFKGKYLHMYGARDIDGTLFPTYIYQKIDESKLKPYTRYQIRGFVGSSKELKLMVIRYGKEIDTIMNVPNDIPYVPSMLSCNELYNSEQSLYQKRNVDYYNQMPEYTFNTYQCIPDQKQAICHDSHQFKFHIDIGEVDYNTNLGMLVLFKISSPDGYATLGNLEVIEEGPITGEALVLVKQKEKKWNQHMEKKRMDTKQAYDRAKEAVDALFTGEELNYNVTLSQIKNADQLVQSIPYIHNIQGLQGWHAEGKVEIQQMNRMSVLVLSNWSSGVSQNLHVQHQHGYVLRVSAKKEGPGKGYVTMMGCNGRQETLMFTPCDGGYMTKTLEVFLDTDRIRIEIGETEGSFYIESIELNCVKGYNNEYN

SEQ ID NO: 145 - DNA, 2091 bp, Bacillus thuringiensis
atgaatggaggagagaatatgaatcaaaataatcaaaatgaaatgcaaataatagattcttcatccaatgattttagtcaatcaaacaggtatccaagatatccattagctaaagagtcaaattataaagattggctagctagttgtgatgaatcaaatgtagatacgctatcagctacaagtgatgtaaagggttcagtctccagggttttgggtattgtgaatcagattttgggttttctgggtcttggatttattggaacaggtcttggtatactaggtgatttatttaattcattttggccatccaataataatgcggtttgggaggcttttctacgtagtgttgaagaactaattgatgaacgaatacgtgaagctgagaggtcccgtatcgtagccgaatttaatggtttaagaaacgttatgttcaattataatggtgctcttgaggattgggatagaaatcgtgaggataccgcacttcaaagtgaagtaaaaagccgcttcgataatgcagatgatttttttgcaaatcgtattcctgtatttgcaatagaagggtttgaagtacaatcgctagctgtatatgcacaggctgcaactcttcatttattattattaagggatggggttcttaatgggctgctatggggacagaatgccgatacggttaaccgtaattataacaaattggtagaaaagagtggtcaatatacagatcattgtacatccttttataggcagggtttgcaggagttaaggaacagagggaattggaatgcattcaatacttatcgcagaaacatgactcttcaagtattagatgtcatttctttattttcaaattatgaccctcgcatatatagaaataatacaaacacacaacttacaagagaaatatatactgaaccacttgctgttcctggatggcttaattctcattccaatccaactcaattccaacaaatagaaaatgatcttattcgctcaccttcagtgttttctaatctccagactctttttatggaagctggttttgcattcttccaagccggtatagctaggcaaacagtgttaagaacacgtacgtctagtttaaatacggggcgtactgctgtcatcgtaactccttggcaaggtgcacctcatcctaatgtttcacaacaactgcaggtgcaatttgaaaataggaatgtttttaatatcaactcagtagtaggtagggaaatttctagtcaaaccggcttattatttggggtccaacaagccatttttaactttgtgtacgaaggcggaaacgcagcttcgacaacacaattcaatctaccgatttctggacattcaaattctataacatctaatataccaggaacaaactcaacaactccaaccgcttcagattatactcatagactatcttcgataacttcaacttcagtaggaacttggcagagagataggacgaatattatggcttatggatggacacatgttagtgcagagcgtactaataggattataccgaatagaattacacaaattccggctgtaaaaggatcactgtttagtgataatccaccaaacacattacgaacacgtgtagaaagtggccctggtcatactgggggcggactcgttgttatgggcggaggaacaagtgtattacagatgagaatcacttcttcagcacggcaaaggtatgatatgcgtttacgttatctagctcttgctccagctgctgttgaagtaagaattccggaattaggggtgcatgttaggtttcagatgccacagactgcaacgatgttgcctgcgcctctaccatacagccatttgcgatatgtggatatcccgctgaggtttgagacacccaatggtgaaaatacttggacgtttgaactacggactacgaatgcagcagttacaattgacagggtcgaattcataccagttaatgctacagctttagaatatgaaggaaaacgacatctagaaaaagcaaagaaagccgtgggtgatctgtttatcaataatggaaaagaggctttaaaagtagatacgacggattatgatgtgaatcaagctgca

SEQ ID NO: 146 - protein, 697 aa, Bacillus thuringiensis
MNGGENMNQNNQNEMQIIDSSSNDFSQSNRYPRYPLAKESNYKDWLASCDESNVDTLSATSDVKGSVSRVLGIVNQILGFLGLGFIGTGLGILGDLFNSFWPSNNNAVWEAFLRSVEELIDERIREAERSRIVAEFNGLRNVMFNYNGALEDWDRNREDTALQSEVKSRFDNADDFFANRIPVFAIEGFEVQSLAVYAQAATLHLLLLRDGVLNGLLWGQNADTVNRNYNKLVEKSGQYTDHCTSFYRQGLQELRNRGNWNAFNTYRRNMTLQVLDVISLFSNYDPRIYRNNTNTQLTREIYTEPLAVPGWLNSHSNPTQFQQIENDLIRSPSVFSNLQTLFMEAGFAFFQAGIARQTVLRTRTSSLNTGRTAVIVTPWQGAPHPNVSQQLQVQFENRNVFNINSVVGREISSQTGLLFGVQQAIFNFVYEGGNAASTTQFNLPISGHSNSITSNIPGTNSTTPTASDYTHRLSSITSTSVGTWQRDRTNIMAYGWTHVSAERTNRIIPNRITQIPAVKGSLFSDNPPNTLRTRVESGPGHTGGGLVVMGGGTSVLQMRITSSARQRYDMRLRYLALAPAAVEVRIPELGVHVRFQMPQTATMLPAPLPYSHLRYVDIPLRFETPNGENTWTFELRTTNAAVTIDRVEFIPVNATALEYEGKRHLEKAKKAVGDLFINNGKEALKVDTTDYDVNQAA

SEQ ID NO: 147 - DNA, 915 bp, Bacillus thuringiensis
atgacagtggttgattttaatcaattaattacagcgtacgctcaaagtatggcgagctcccccggtaatcaaggggttacatttacagggcaatatggatatatagaggtaggcgatcctagtggggctccaccctttatagttagtaatgtcgtggccaatccagatacaaccacatataatttttcacctggaagtagtgtattctcatcctctcaagttgttcaaaacagctcggatgttccgataacacaaagtttggccttaggtcaagccgtgcaagatagtaactctacgtcaacaacaaatggccttagtactaattattctatcactactaaaagtacctttacaattaaatttggtgtcacagatggaaactcgatttcagaagagattgatgctacattcggtcaaacatttaattttagtaccacagactccaatacacaaacagagtcccaaaattggaccgaaacgacatcctttacggttcctccctactctcaaatgactgtattatacactgtgttaggagggacttatagtatcaatacaactttaacgtgtgagttacaaggatgcatttggtttaccttaaattatccaggcataggtgatgtaaaagaaatagtggatatctattttgtcattgaaaatgcgggtttaaatggcagttatccaccaccaggtgatacgggaacaccatttagtatatcagagcctggagaggttgcattttttggaggaacgggtgaatttacggggacacaaggcatacagtcaattgttacagcaacttcatctcccctacctggttacccaggacaaacaaccacaagtactacgccattaacttcaattaattctgatggtactgtcaccccagcaagctcgcctatccctatttatagt

SEQ ID NO: 148 - protein, 305 aa, Bacillus thuringiensis
MTVVDFNQLITAYAQSMASSPGNQGVTFTGQYGYIEVGDPSGAPPFIVSNVVANPDTTTYNFSPGSSVFSSSQVVQNSSDVPITQSLALGQAVQDSNSTSTTNGLSTNYSITTKSTFTIKFGVTDGNSISEEIDATFGQTFNFSTTDSNTQTESQNWTETTSFTVPPYSQMTVLYTVLGGTYSINTTLTCELQGCIWFTLNYPGIGDVKEIVDIYFVIENAGLNGSYPPPGDTGTPFSISEPGEVAFFGGTGEFTGTQGIQSIVTATSSPLPGYPGQTTTSTTPLTSINSDGTVTPASSPIPIYS

SEQ ID NO: 149 - DNA, 2373 bp, Bacillus thuringiensis
atgaacatgaacaagaataatactaaattaagcgcaagagccttaccaagttttattgattattttaatggcatttatggatttgcgatgggtatcaaagacattatgaacatgatttttaaaacggatacaggtggtgatctaaccctagacgaaattttaaagaatcagcagttactaaatgatatttctggtaaattggatggggtgaatggtagcttaaatgatcttatcgcacagggaaacttaaatacagaattatctaaggaaatattaaaaattgcaaatgaacaaaatcaagttttaaatgatgttaataacaaactcgatgcgataaatacgatgctgcatatatatctacctaaaattacctctatgttaagtgatgtaatgaaacaaaattatgcgctaagtgtgcaaatagaatacctaagcaaacaattgcaagaaatttctgataagctggatattattaacgtaaatgtacttattaactctacacttactgaaattacacctgcgtatcaacggattaaatatgtgaacgaaaaatttgaggaattaacttttgctacagaaactaatttaaaagtaaaaaaggatggctctcctgcagatattcttgatgagttaactgagttaactgaactagcgaaaagtgtaacaaaaaatgatgtggatggttttgaattttaccttaatacattccacgatgtaatggtaggaaataatttattcggacgttcagctttaaaaactgcatcggaattaattactaaagaaaatgtgaaaacaagtggcagtgaggtcggaaatgtttataatttcttaattgtattaacagctctgcaagcaaaagcatttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaattagtaatgattcaatcacagtattaaaagtgtatgaggctaagctaaaacaaaattatcaagttgataaggattccttatctgaagttatttatggtgatatggataaattattgtgtccagatcaatctgaacaagtatattatacaaataacatagtatttccaaatgaatatgtaattactaaaattgattttactaaaaaaatgaaaactttaagatatgaggtaacagcgaatttttatgattcttctacagggaaaattgacttaaataagacaaaagtagaatcaagtgaagcggagtatagaacgttaagtgctaaagatgatggagtgtatatgccgttaggtgtcatcagtgaaacatttttgactccgattaatgggtttggccttcaagctgatgaaaattcaagattaattactttaacatgtaaatcatatttaagagaggtattattagcaacagacttaagtaataaagaaactaaattaattgtccctcctattagttttattagtaatattgtagaaaatgggaacttagagggagaaaacttagagccgtggatagcaaataacaaaaatgcgtatgttgatcatgcaggcggtataaatggaactaaagttttatatgttcataaggatggtgagttttcacaatttattggaggtaagttaaaatcgaaaacagaatatgtaattcaatatattgtaaaaggaaaagcatctatttatttaaaagataaaaaaaatgagaattccatttatgaagaaaaaaataatgatttagaagattttcaaactgttactaaacgttttattacaggagcggattcatcaggagtttatttaatatttagcagtcaaaatggtgaggaagcatttggggggaactttattatttcagaaattaagtcatccgaagagttattaagtccagagttgataaaatcggatgcttgggttggatctcagggaacttggatctcaggaaattctctcacaatttatactaatacaaatggaacttttcgacaaaaccttccgttagaaagttattcaacttatagtatgaactttaatgtaaatggatttggcaaggtgacaataagaaattctcgtgaagtattatttgaaaaaaactatatgcagctttcgcctaaagatttttctgaaaaattcacaactacagccagcaataccggattgtatgtagagctttcacgaggaacatcgagtggtaatataaatttccgagatttttcaattaagaataga

SEQ ID NO: 150 - protein, 791 aa, Bacillus thuringiensis
MNMNKNNTKLSARALPSFIDYFNGIYGFAMGIKDIMNMIFKTDTGGDLTLDEILKNQQLLNDISGKLDGVNGSLNDLIAQGNLNTELSKEILKIANEQNQVLNDVNNKLDAINTMLHIYLPKITSMLSDVMKQNYALSVQIEYLSKQLQEISDKLDIINVNVLINSTLTEITPAYQRIKYVNEKFEELTFATETNLKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQVYYTNNIVFPNEYVITKIDFTKKMKTLRYEVTANFYDSSTGKIDLNKTKVESSEAEYRTLSAKDDGVYMPLGVISETFLTPINGFGLQADENSRLITLTCKSYLREVLLATDLSNKETKLIVPPISFISNIVENGNLEGENLEPWIANNKNAYVDHAGGINGTKVLYVHKDGEFSQFIGGKLKSKTEYVIQYIVKGKASIYLKDKKNENSIYEEKNNDLEDFQTVTKRFITGADSSGVYLIFSSQNGEEAFGGNFIISEIKSSEELLSPELIKSDAWVGSQGTWISGNSLTIYTNTNGTFRQNLPLESYSTYSMNFNVNGFGKVTIRNSREVLFEKNYMQLSPKDFSEKFTTTASNTGLYVELSRGTSSGNINFRDFSIKNR

SEQ ID NO: 151 - DNA, 2364 bp, Bacillus thuringiensis
atgaacatgaacaagaataatactaaattaagcgcaagagccttaccaagttttattgattattttaatggaatttatggatttgccactggcatcaaagacattatgaacatgatttttaaaacggatacaggtggtgatctaaccctagacgaaattttaaagaatcagcagttactaaatgatatttctggtaaattggatggggtgaatggtagcttaaatgatcttatcgcacagggaaacttaaatacagaattatctaaggaaatattaaaaattgcaaatgaacaaaatcaagttttaaatgatgttaataacaaactcgatgcgataaatacgatgcttcatatatatctacctaaaattacatctatgttaagcgatgtaatgaagcaaaattatgcgctaagcctgcaaatagaatacctaagtaaacaactgcaagaaatttctgataagctggatattattaacgtaaatgtacttattaactctacacttactgaaattacacctgcgtatcaacggattaaatatgtgaacgaaaaatttgaggaattaacttttgctacagaaactaatttaaaagtaaaaaaggatggctctcctgcagatattcttgatgagttaactgagttaactgaactagcgaaaagtgtaacaaaaaatgatgtggatggttttgaattttaccttaatacattccacgatgtaatggtaggaaataatttattcgggcgttcagctttaaaaactgcatcggaattaattactaaagaaaatgtaaaaacaagtggcagtgaggtcggaaatgtttataacttcttaattgtattaacagctctgcaagcaaaagcatttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaattagtaatgattcaatgacagtattaaaagtatatgaggctaagctaaaacaaaattatcaagttgataaggattccttatcggaagtcatttatggtgatatggataaattattgtgcccaggtcaatctgaacaaatttattatacaaataatatagtattttcaaatgaatatgtaattactaaaattgattttactaagaaaatgaaaactttaagatatgaggtaacagctaattcttatgattcttctacaggagaaattgacttaaataagaagaaagtagcatcaagtgaagcggagtataggacgttaagtgctaatgatgatggagtgtatatgccgttaggtgtcataagtgaaacatttttgactccgattaatgggtttggcctccaagctgatgaaaattcaagattaattactttaacatgtaaatcatatttaagagaactactgctagcaacagatttaagcaataaggaaactaaattgatcgtcccaccaaatggttttattagcaatattgtagagaacgggtccatagaagaggacaatttagagccgtggaaagcaaataataagaatgcttatgtagatcatacaggcggagtgaatggaactaaagcattatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttagaagattatcaaactattactaaacgttttactacaggaactgatttaaagggagtgtatttaattttaaaaagtcaaaatggcaatgaagtttttggagataactttattatctcagaaattaggcctttagaagagttattaagtccagaattaataaaatcggatgcttggattcgatctcagggtacttcgggtagtggaaactctctctttattagtaataatgcaaatggaacctttagacaaaatctgtcgttagaaaactattcaacttatagtatgaactttaatgtgaatgggtttggcaaggtgacagtaagaaattatcgcgaagtagtatttgaaaaaacatatcctcagttaacacctagagatatttcggaaaagttcacaacaaccaataatactggattatatgtagaactttctcgtggcacgggacctgggtctataaatttccgtgacttttcaattaaa

SEQ ID NO: 152 - protein, 788 aa, Bacillus thuringiensis
MNMNKNNTKLSARALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETNLKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSMTVLKVYEAKLKQNYQVDKDSLSEVIYGDMDKLLCPGQSEQIYYTNNIVFSNEYVITKIDFTKKMKTLRYEVTANSYDSSTGEIDLNKKKVASSEAEYRTLSANDDGVYMPLGVISETFLTPINGFGLQADENSRLITLTCKSYLRELLLATDLSNKETKLIVPPNGFISNIVENGSIEEDNLEPWKANNKNAYVDHTGGVNGTKALYVHKDGGFSQFIGDKLKPKTEYVIQYTVKGKPSIHLKDENTGYIHYEDTNNNLEDYQTITKRFTTGTDLKGVYLILKSQNGNEVFGDNFIISEIRPLEELLSPELIKSDAWIRSQGTSGSGNSLFISNNANGTFRQNLSLENYSTYSMNFNVNGFGKVTVRNYREVVFEKTYPQLTPRDISEKFTTTNNTGLYVELSRGTGPGSINFRDFSIK

SEQ ID NO: 153 - DNA, 1869 bp, Bacillus thuringiensis
atgaataatatattgaataacgaaagaactactatttgtgatgcgcataatgtagtggctcatgatccatttagttttgaacataaatcagtagataccatccaaaaagaatggacggaatggaagagaactgatcatagtttatacgtagctcctattgttgggaccgttgctagtttgctgctaaagaaagtggggagtcttattggaaaaaggatattgagtgagttatggggtttaatatttcctagtggtagtacaaatctaatgcaagatattttaagagcgacagaacaattcataaatcaaagacttaatgcagacactctcgctcgtataaatgcagaattggtagggcttcaatccaatgtaagggagtttaatcaacaagtagataattttttaaaccctactcaaaaccctgttcctttatcaataacttcttcagttaatacaatgcagcaattatttctaaatagattaccccagttccagatacaaggatacgagctgttattattacctttattcgcacaagcagccaatatgcatctttcttttattagagatgttattcttaatgcagatgaatggggcatttcaccagcaatgttacgtacatatcgagattacctaaaaagatatacaaacgaatattccaattattgtataaatacgtatcgaactgaatttgaagggttaaatgttcctttaaaagatatgttagaatttagaacctatatgtttttaaatgtatttgaatatgtatcgatatggtcgctatttaaataccagagccttctggtaacttctggcgctaacttgtatgtttctggtacaactgtaggtgcaaatcaatcttttactgcaagaaattggccgtttttaaatactcttttccaagttaattcaaattatatattgactggatttagtggagctagatttcaatcaaccgtactcaattcatttgttatcacattattggctgcacgtattcattacatgggaggagtctcatctggtaatttaggtccagcagctaactataatgttggttgtaatttatcatcccctatacaattgccatatcgaacatcttatttagactcatttatattaagagatggaaatcgaacaaatgaatattttacgggcgcttttcttgcattgatactaccttgtggtgttactggacctactctgggtgcagctaactctttcccaaattattctatacggaatatttctggggctgttggctggtttagaaatgaagatttaggaagacctttacattttaatgaaataagaaatatagaaggtcaaccgggagtaggtggtggaagtagaatctctagtttagtatctgtgcataacagaaaaaataatatcgtcgctcatgaaaatggtactatgattcatttagcgccagatgattatacaggattcactatatcaccgatacatgcaactcaagtgaataatcaaacgcgaacaattatttctgaaaaatttggaaatcaaggtgattccttaaggtttgaacaaagcaacacgacagctcgttatacgcttagagggaatggaaatagttacaatctttatttaagagtatcttcaataggaaattccactattcgggttactataaacggtagagtttatactgctacaaatgttaatactactacaaataacgatggagtacttgataatggagctcgtttttcagatattaatatcggtaatgtagtggcaagtgctaatactaatgtaccattagatataaatgtgacatttaacgccaatacaccatttgatcttatgaatattatgtttgtaccaactaatcttccaccagtttat

SEQ ID NO: 154 - protein, 623 aa, Bacillus thuringiensis
MNNILNNERTTICDAHNVVAHDPFSFEHKSVDTIQKEWTEWKRTDHSLYVAPIVGTVASLLLKKVGSLIGKRILSELWGLIFPSGSTNLMQDILRATEQFINQRLNADTLARINAELVGLQSNVREFNQQVDNFLNPTQNPVPLSITSSVNTMQQLFLNRLPQFQIQGYELLLLPLFAQAANMHLSFIRDVILNADEWGISPAMLRTYRDYLKRYTNEYSNYCINTYRTEFEGLNVPLKDMLEFRTYMFLNVFEYVSIWSLFKYQSLLVTSGANLYVSGTTVGANQSFTARNWPFLNTLFQVNSNYILTGFSGARFQSTVLNSFVITLLAARIHYMGGVSSGNLGPAANYNVGCNLSSPIQLPYRTSYLDSFILRDGNRTNEYFTGAFLALILPCGVTGPTLGAANSFPNYSIRNISGAVGWFRNEDLGRPLHFNEIRNIEGQPGVGGGSRISSLVSVHNRKNNIVAHENGTMIHLAPDDYTGFTISPIHATQVNNQTRTIISEKFGNQGDSLRFEQSNTTARYTLRGNGNSYNLYLRVSSIGNSTIRVTINGRVYTATNVNTTTNNDGVLDNGARFSDINIGNVVASANTNVPLDINVTFNANTPFDLMNIMFVPTNLPPVY

SEQ ID NO: 155 - DNA, 1941 bp, Bacillus thuringiensis
atgaattcgaataataaaactaaccctaatgtaataggcacttcatctgaccaatctttattaaccaactctgtaaaaaaaccttcggcaaacgatcaaagcaatccattacaacatagggattctaatgattgtttgagtgtgtctgagggaaatagagattctctgaattatgatgtgtttattagtgccccaggtctagttgatactacagctaatattacaagtgttatactgagtgctttaggtgttccgatgttagggactgttgttaaattatatagtaaattatttggttttttatggggatcaacgccaggacaagatccttggaaagagctgatggatcgagtggaaatactcattgatcagaaattaacagaatacgcaagaagtaaagcattagcagaattggaaggattgcaaaatgttatgaagtcttatgtggatgcacttgaatcatggcaaaataattctcggaattcacaaacaagattattagtacaacagagattggttgttgcagattcgcaatttaaacaggcaatgccttcctttgcaattaaagattatgaagtttcattattaccggtatatgcacaagctgcaaatcttcatttacttttattaagagatagccagattttcggaaaagattggggaatgcctcaacatgaaattgatcttttttataaagaacacttagagtgcatagaaaaatattctgaccattgtgtggaatggtatcatactggcttaaataaacttaaaggttcaactgctaaggattgggttgactacaatcgtttccgaagagaaatgacagtggcagttttagatatcattgctttacttcctaattatgatgtacacatgtatccaatgccaatacatgcagaacttacacgggaaatttatacaaatccagttgggagttatttgccctacaaaggtaatttcaaggatgttatgtcttggtatgaaatgaaaagatatcgccagcctacatttcacgatttagaaagtttaatccgaaagcctagtcggtttacttggctaaaagatcttaagatgtatacaaggaaaagacaaaatgggaaatatgagtattataattattgggtaggacatcagttagagaaagcgttaattggtgaaaaatacctaagagaaacaacaattagtggtgaaattacaagtgaagaagatacatttacttttgaagattatgatattcatagggttttatgcaattatatagggagatacgataatagtttggtgggggtaaaccaagttgagtttcattatctcgataacaatacacctcggaagaaggaatataaaaaagatatttgggttacgagtcaatcacaaaaaataattgactcagaagaggaattacatagtcatagattaagttatgttgaatcttttgatttatattggaatcataacaatgagaaaggagggacaatacccgtatttggttggacacatcatagtgtagcccctaaaaatataattcatgaggataagattacagtaatctcagctactaaagctaatggttatttcacttctgaagttatacaaggtcctggatattcaggaggggatttaataaaaggatctaatagcatgggaaacattcaattaactccacctcgtgatgcactcaacaaaaagtatcgtttgagaattcgctatgccgctgattcagatgatttacttacaatgacttttacctctggtattggaccagttaaatatcaaacgctctatcaagcaacaatgaaaaaaggggattctttcaaatataattcctttcaatatgtagaaaaagtagtacatatttcgtctggtataaacggcataaaattcagtacaggaagtggtttttacttggataaggttgaatttattccagtgaatgaaaat

SEQ ID NO: 156 - protein, 647 aa, Bacillus thuringiensis
MNSNNKTNPNVIGTSSDQSLLTNSVKKPSANDQSNPLQHRDSNDCLSVSEGNRDSLNYDVFISAPGLVDTTANITSVILSALGVPMLGTVVKLYSKLFGFLWGSTPGQDPWKELMDRVEILIDQKLTEYARSKALAELEGLQNVMKSYVDALESWQNNSRNSQTRLLVQQRLVVADSQFKQAMPSFAIKDYEVSLLPVYAQAANLHLLLLRDSQIFGKDWGMPQHEIDLFYKEHLECIEKYSDHCVEWYHTGLNKLKGSTAKDWVDYNRFRREMTVAVLDIIALLPNYDVHMYPMPIHAELTREIYTNPVGSYLPYKGNFKDVMSWYEMKRYRQPTFHDLESLIRKPSRFTWLKDLKMYTRKRQNGKYEYYNYWVGHQLEKALIGEKYLRETTISGEITSEEDTFTFEDYDIHRVLCNYIGRYDNSLVGVNQVEFHYLDNNTPRKKEYKKDIWVTSQSQKIIDSEEELHSHRLSYVESFDLYWNHNNEKGGTIPVFGWTHHSVAPKNIIHEDKITVISATKANGYFTSEVIQGPGYSGGDLIKGSNSMGNIQLTPPRDALNKKYRLRIRYAADSDDLLTMTFTSGIGPVKYQTLYQATMKKGDSFKYNSFQYVEKVVHISSGINGIKFSTGSGFYLDKVEFIPVNEN

SEQ ID NO: 157 - DNA, 1914 bp, Bacillus thuringiensis
atgaataatgtattgaatagcggaaaatctagtagttgtgatccttataacgtagtggttcatgatccatttagttttcaacataaatcattagataccatacaaaaagaatggacggagtggaaaagaacagatcatagtttatatgtagcccctattgtgggaactgtggctagttttctgttaaagaaagtagggagccttgttggaaaaaggataatgagtgagttacagaatttaatatttcctaatggtgatgtaaatttagtggaagagattttaagaacgacagaacaattcctaaatcaaagacttagtacagacacctttgaacgtgtaaaagcagaattggaaggtcttcaaaggaatgtggaagagtttaatcgacaagtagataattttttaaaccctaatcaaacccctgttcctttagcgataattgattcagttaatacattgcagcaattatttctaggtagaataccccagtttcgactatcaggctacgagctgttattattacctttatatgcacaggtggctaacttacatctttcttttattagagatgtcatccttaatgcagatgaatggggaattacatctgaagcaacattacgtacgtatcgaggttacctgaaagattatacaaaagagtactctaatcattgtataactacgtatcaaaatgcgtttagaggtttaaacaccagtttacacgatatgttagaatttagaacctatatgtttttaaatgtatttgaatatgtctctatctggtcgttgtttaaatatcaaagtcttctagtatcttccggcgctaatttatatgcaagtggtagttcaattggtagtgtaccagagcggacccaaacatatacttcacaagactggccatttttaaattcccttttccaagttaattcaaattatatattatctggttatagtggttttaggctttttgctggtacccctaatcctggtcttcctccaggctctactacaattcaagcattgcttggtgcaagggttaattatagtggagggatttcgtctggtgatataggtacatctccatttaatcagaattttaattgtaacacatctttgttaacaccttatgttaggagttggctagattcaggttcagatcggcagggccttaatacctctacaaattggcaaacagaatcctttgggacaactgcaggctcatggtgtggtgcttttacacctcgcggtaattcaaactatttccctgattattttatccgtaatatttctggcgttcctttagttgttagaaatgaagatttaagaagaccgttacactataatgaaagaagaaatatatcaagtcctccaggaacacctgttggaggaagagcatatatggtatctgtgcataacagaaaaaataatatctatgatactcatgaaaacggtactatgattcatttggcgccggaagattatacaggatttactatatcaccgatacatgcaactcaagtgaatagtcaagctaatcaagcgcgaacatttatttctgaaaaatttggaaatcagggtgattccttaagggttgaacaaagcacctcaacggttcaatacacatttagagggaatggaaatagttacaatctttatttaagagtatcttcaataggaagttccactattcgagtttcaataaacggtagagtttatactgttcaaaatgttaatactactacaaataatgatggagtacttgataatggagctcgtttttcagatatttatatcggtaatgtagtggcaagtgctaatactaatgtaccattaaatataacacctacatttaacaccggtacacaatttgagcttatgaatattatgtttgtgccaactaatatcccaccactatat

SEQ ID NO: 158 - protein, 638 aa, Bacillus thuringiensis
MNNVLNSGKSSSCDPYNVVVHDPFSFQHKSLDTIQKEWTEWKRTDHSLYVAPIVGTVASFLLKKVGSLVGKRIMSELQNLIFPNGDVNLVEEILRTTEQFLNQRLSTDTFERVKAELEGLQRNVEEFNRQVDNFLNPNQTPVPLAIIDSVNTLQQLFLGRIPQFRLSGYELLLLPLYAQVANLHLSFIRDVILNADEWGITSEATLRTYRGYLKDYTKEYSNHCITTYQNAFRGLNTSLHDMLEFRTYMFLNVFEYVSIWSLFKYQSLLVSSGANLYASGSSIGSVPERTQTYTSQDWPFLNSLFQVNSNYILSGYSGFRLFAGTPNPGLPPGSTTIQALLGARVNYSGGISSGDIGTSPFNQNFNCNTSLLTPYVRSWLDSGSDRQGLNTSTNWQTESFGTTAGSWCGAFTPRGNSNYFPDYFIRNISGVPLVVRNEDLRRPLHYNERRNISSPPGTPVGGRAYMVSVHNRKNNIYDTHENGTMIHLAPEDYTGFTISPIHATQVNSQANQARTFISEKFGNQGDSLRVEQSTSTVQYTFRGNGNSYNLYLRVSSIGSSTIRVSINGRVYTVQNVNTTTNNDGVLDNGARFSDIYIGNVVASANTNVPLNITPTFNTGTQFELMNIMFVPTNIPPLY

SEQ ID NO: 159 - DNA, 2124 bp, Bacillus thuringiensis
atgaatcgaaataatcaaaatgaatatgaagttattgatgccccccattgtgggtgtccgtcagaggatgttgtaaaatatcctttgacagatgattcgaatgctggattgcaaaatatgaattataaagagtatttgaatatgtctgagggagattatgctgattcaattagatatcctttagccaataatccatattcatctgctttaaatttaaattcttgtcaaaatagtagtattctcaactggattaacatattaggaaatgcagcaaaagaagccatatctattgggacaacaataatctctattattacaacaccttctctcactggattaatttcaataacttatgatcttataagtaaagtgctaggaggtagtagtggcccatccatatcagatttgtctatatgtgacttattatctattattgatttacggataagtcaaagtgttttgaatgatgggattgctgattttaacggttctataatcatatataggaactatttggaagcattagatagctggaataagaataatactcctgctgctgctgaagaggtccgtgctcgttttagagccgctgacacagaatttgatagaattttaacacgagggtctttaacaaatggtggctcgttagctagacaagatggccaaatattattattaccttcttttgcaagtgctgcatatttccatttatcactattgagagatgctgctaggtatggggctaattgggggctattcaatgctacacctcttataaattatcagtcaaaattagtagaacttattgaatcatatactaattattgtgtacattggtataatcaaggtcttaaccaactaaggcaacgaggtaatagtgctacagcttggttagaatttcatagatatcgtagagagatgacattgatggtattagatatagtagcatcattttcaagtcttgatattactagatatccgatagaaacagattttcagttgagtagggtcatttatacagatccaatcggttttgtaaatcgtggtaatcttaggctggaaagctggttcagctctgttaataacgctactttttcagggctagaaagtgcaatacctaatcctagccagtcttggtttttaaatagtatgattatatctactggttcacttacattgccagttagcccaaatactgatagagcgagggtgtggtatggggggcgagatcgagtttctcctgctagttcacaatttattactgaacaaatgtctgggcaacagacggctgatacccaaaatattttagggcgaaatatatttagaatagattctcaagcatgtaatttaaataataccacttatggagttaatagggctttattttatcatgatgctagtcagggttctcaaagatctttatatgaaggttttattagaacaacagggatagataatcctgttgttcagaatattaacacttatttccctggagaaaattcagatatcccaactccacaagactatactcatatattaagtagaacaataaatttaacagggggacttagacaagtagcatctggtcgtcgttcttctctagtaatgtatggttggacacataagagcctgactcttaacaataccattaatccagatagaattacacagataccgttgacaaagctagatagccggggttcaaatatttcttatgtgaacgatccaggatttataggcggaaatctactcagaatgacggccaatggtacacttggaacattaagggcaaatttcccacttaacattagatcacattttcgcattagagtccgttatgctgctacaagaaatattcgattgagtgtaaatggaagtttcggtactatttctcaggaatttcctagtacaatgagattgggagaggatttaagatacggttcctttgctataagagagtttagtacatctgttagacccactgcaagtcctgacgtaatccgattgacagtagagccaattttctctgggcaacagatttatgtagacagaattgagttcgtcccagttattcccacaagagaagcggaagagaatttagacgcagcgaagaaagcggtggcg

SEQ ID NO: 160 - protein, 708 aa, Bacillus thuringiensis
MNRNNQNEYEVIDAPHCGCPSEDVVKYPLTDDSNAGLQNMNYKEYLNMSEGDYADSIRYPLANNPYSSALNLNSCQNSSILNWINILGNAAKEAISIGTTIISIITTPSLTGLISITYDLISKVLGGSSGPSISDLSICDLLSIIDLRISQSVLNDGIADFNGSIIIYRNYLEALDSWNKNNTPAAAEEVRARFRAADTEFDRILTRGSLTNGGSLARQDGQILLLPSFASAAYFHLSLLRDAARYGANWGLFNATPLINYQSKLVELIESYTNYCVHWYNQGLNQLRQRGNSATAWLEFHRYRREMTLMVLDIVASFSSLDITRYPIETDFQLSRVIYTDPIGFVNRGNLRLESWFSSVNNATFSGLESAIPNPSQSWFLNSMIISTGSLTLPVSPNTDRARVWYGGRDRVSPASSQFITEQMSGQQTADTQNILGRNIFRIDSQACNLNNTTYGVNRALFYHDASQGSQRSLYEGFIRTTGIDNPVVQNINTYFPGENSDIPTPQDYTHILSRTINLTGGLRQVASGRRSSLVMYGWTHKSLTLNNTINPDRITQIPLTKLDSRGSNISYVNDPGFIGGNLLRMTANGTLGTLRANFPLNIRSHFRIRVRYAATRNIRLSVNGSFGTISQEFPSTMRLGEDLRYGSFAIREFSTSVRPTASPDVIRLTVEPIFSGQQIYVDRIEFVPVIPTREAEENLDAAKKAVA

SEQ ID NO: 161 - DNA, 1656 bp, Bacillus thuringiensis
atgaattctaaatctatcatcgaaaaagaggtacaagagaatcaatatattgatattcgtaacatttgtagcataaatggttctgctaaatttgatcctaatactaacattacaaccttaacagaagctataaatactcaagcaggtgcgattgctggaaaaactgccttagatatgagacgtgattttactctcgtagcagatatatacctagggtctaaaggcagtggggctgatggtattgctatagcgtttcatagaggatcaattggttttatcggtactatgggcggaggattaggaattctaggagcacccaacgggataggatttgaaatagatacgtattggaaagcatcttcagatgaagcaggggattcatttgggcatggtcaaatgaatggaccacatgcaggttttgtgagtacaaatcgaaatgcaagctatttaacagccttagctcctatgaaaagaatagctccacctaatggtcaatggagggtgttaactattaagtgggatgcgcgtaacaacaaactaacagcaagtcttcaagagaaaagcaacgatgatcctactagatctgctacaccaagatatcaaacatgggagttattaaatcctgcatttgatttaaatcagaaatatacttttgttattggctcagctacaggggctgctaataacaagcatcagatcggagttactttgtttgaagcacactttacaaaaccaactatagaggcaaaccctgttgatattgaactaggtacagcgtttgatccattaaactatgagccaattggactcaaggcaacagatgaagtagatggagatataacaaaggacatcacggtagaatttaatgacgtagatacatccaaaccaggtgcataccgtgtaacatataaagtaataaatagttatggagaaagtgatgagaaaacaataggagtcgtagtatatacgaaaccaactataactgcacatgatgtcgcgattaagaaagacttagcatttgatccattaaaatatgaaccaattggactcaaagcaacagatccaattgatggagatataacagataaaattactgtaaaatttaataatgtcgatacctcgaaaccaggtaaataccatgtaacatataaagtgataaatagttatgaaaaaattgatgaaaaaacaattgccgttacggtacctgttattgatgatgggtgggagaatggcgatccgacaggatggaaattcttctctggtgaaaccattactctagaagaagatgaagagaatgctcttaatggaaaatgggtattttatgctgataaacatgtagcaatatacaaacaagtagagttgaagaataataccccttatcaaattacagtatatgttaaaccagaagatgaaggaactgtggcacaccatattgttaaagtatctttcaaatcggattctgctggtcaagaaagtgaagagattctaaatgaaagattaattgatgcagaacagatacaaaaaggatacagaaagttaacaagtattccatttacaccaacaacaattgttcccaacaaaaaaccagtgataattgttgaaaactttttaccaggatggataggtggagttagaatcattgtagagcctacaaag

SEQ ID NO: 162 - protein, 552 aa, Bacillus thuringiensis
MNSKSIIEKEVQENQYIDIRNICSINGSAKFDPNTNITTLTEAINTQAGAIAGKTALDMRRDFTLVADIYLGSKGSGADGIAIAFHRGSIGFIGTMGGGLGILGAPNGIGFEIDTYWKASSDEAGDSFGHGQMNGPHAGFVSTNRNASYLTALAPMKRIAPPNGQWRVLTIKWDARNNKLTASLQEKSNDDPTRSATPRYQTWELLNPAFDLNQKYTFVIGSATGAANNKHQIGVTLFEAHFTKPTIEANPVDIELGTAFDPLNYEPIGLKATDEVDGDITKDITVEFNDVDTSKPGAYRVTYKVINSYGESDEKTIGVVVYTKPTITAHDVAIKKDLAFDPLKYEPIGLKATDPIDGDITDKITVKFNNVDTSKPGKYHVTYKVINSYEKIDEKTIAVTVPVIDDGWENGDPTGWKFFSGETITLEEDEENALNGKWVFYADKHVAIYKQVELKNNTPYQITVYVKPEDEGTVAHHIVKVSFKSDSAGQESEEILNERLIDAEQIQKGYRKLTSIPFTPTTIVPNKKPVIIVENFLPGWIGGVRIIVEPTK

SEQ ID NO: 163 - DNA, 1902 bp, Bacillus thuringiensis
atgaatagtgtattgaatagcggaagaactaccactcgtgatgcgtataatgtagtggctcatgatccatttagttttcaacacaaatcattagataccatacaaaaagaatggacggagtggaaaaaaaataatcatagtttatatgtagatcctattgttggaactgtggctagttttctgttaaagaaagtgggaagtcttattggaaaaaggatactaagtgagttacggaatttaatatttcctagtggcagtacaaatctaatgcaagatattttaagagagacagaaaaattcctgaatcaaagacttaatacagacactcttgcccgtgtaaatgcggaattgacagggatgcaagcaaatgtagaagagtttaatcgacaagtagataattttttgaaccctaaccgaaacgctgttcctttatcaataacttcttcagttaatacaatgcagcaattatttctaaatagattaccccagttccagatgcaaggataccaactgttattattacctttatttgcacaggcagccaatttacatctttcttttattagagatgttattcttaatgcagatgaatggggaatttcagcagcaacattacgtacgtatcgagattacctgaaaaattatacaagagattactctaactattgtataaatacgtatcaaagtgcgtttagaggtttaaacaccagtttacacgatatgttagaatttagaacctatatgtttttaaatgtatttgaatatgtctctatctggtcgttgtttaaatatcaaagtcttctagtatcttccggcgctaatttatatgcaagtggtagttcaattggtagtgtaccagagcggacccaaacatatacttcacaagactggccatttttaaattcccttttccaagttaattcaaattatgtattatctggttatagtggtgctagaatttttattactagccctaatattggtctacctcctggcactactacaactcaagcattgcttggtgcaagggttaattatagtggagggatttcgtctggtgatataggtacatctccatttaatcagaattttaattgtaacacatctttgttaacaccttatgttaggagttggctagattcaggttcagatcggcagggccttaatacctctacaaattggcaaacagaatcctttgggacaactgcaggctcatggtgtggtgcttttacacctcgcggtaattcaaactatttccctgattattttatccgtaatatttctggcgttcctttagttgttagaaatgaagagttaagaagaccgttacactataatgaaagaagaaatatatcaagtccttcaggaacacctgttggagcacgagcttatatggtatctgtgcataacagaaaaaataatatttataccgttcatgaaaatggtactatgattcatttagcgccagatgattatacaggattcactatatcaccgatacatgcaagtcaagtgaataatcaaacgcgaacatttatttctgaaaagtttggaaatcaaggtgattcgttaaggtttgaacaaagcaacacgacagctcgttatacgcttagagggaatggaaatagttacaatctttatttaagagtatcttcaataggaaattccactattcgagttactataaacggtagagtttatactgctttaaatgttaatactactacaaataacgatggagttaatgataatggagctcgtttttcagatattaatatcggtaatgtagtagcaagtagtaatactgatgtaccattagatgtaaatataacattaaactccggcactcaatttgatcttatgaatattatgtttgtgccaactaatatttcaccactttat

SEQ ID NO: 164 - protein, 634 aa, Bacillus thuringiensis
MNSVLNSGRTTTRDAYNVVAHDPFSFQHKSLDTIQKEWTEWKKNNHSLYVDPIVGTVASFLLKKVGSLIGKRILSELRNLIFPSGSTNLMQDILRETEKFLNQRLNTDTLARVNAELTGMQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFRGLNTSLHDMLEFRTYMFLNVFEYVSIWSLFKYQSLLVSSGANLYASGSSIGSVPERTQTYTSQDWPFLNSLFQVNSNYVLSGYSGARIFITSPNIGLPPGTTTTQALLGARVNYSGGISSGDIGTSPFNQNFNCNTSLLTPYVRSWLDSGSDRQGLNTSTNWQTESFGTTAGSWCGAFTPRGNSNYFPDYFIRNISGVPLVVRNEELRRPLHYNERRNISSPSGTPVGARAYMVSVHNRKNNIYTVHENGTMIHLAPDDYTGFTISPIHASQVNNQTRTFISEKFGNQGDSLRFEQSNTTARYTLRGNGNSYNLYLRVSSIGNSTIRVTINGRVYTALNVNTTTNNDGVNDNGARFSDINIGNVVASSNTDVPLDVNITLNSGTQFDLMNIMFVPTNISPLY

SEQ ID NO: 165 - DNA, 1914 bp, Bacillus thuringiensis
atgaataatgtattgaatagcggaaaatctagtagttgtgatccttataacgtagtggttcatgatccatttagttttcaacataaatcattagataccatacaaaaagaatggacggagtggaaaagaacagatcatagtttatatgtagcccctattgtgggaactgtggctagttttctgttaaagaaagtagggagccttgttggaaaaaggataatgagtgagttacagaatttaatatttcctaatggtgatgtaaatttagtggaagagattttaagaacgacagaacaattcctaaatcaaagacttagtacagacacctttgaacgtgtaaaagcagaattggaaggtcttcaaaggaatgtggaagagtttaatcgacaagtagataattttttaaaccctaatcaaacccctgttcctttagcgataattgattcagttaatacattgcagcaattatttctaggtagaataccccagtttcgactatcaggctacgagctgttattattacctttatatgcacaggtggctaacttacatctttcttttattagagatgtcatccttaatgcagatgaatggggaattacatctgaagcaacattacgtacgtatcgaggttacctgaaagattatacaaaagagtactctaatcattgtataactacgtatcaaaatgcgtttagaggtttaaacaccagtttacacgatatgttagaatttagaacctatatgtttttaaatgtatttgaatatgtctctatctggtcgttgtttaaatatcaaagtcttctagtatcttccggcgctaatttatatgcaagtggtagttcaattggtagtgtaccagagcggacccaaacatatacttcacaagactggccatttttaaattcccttttccaagttaattcaaattatatattatctggttatagtggttttaggctttttgctggtacccctaatcctggtcttcctccaggctctactacaattcaagcattgcttggtgcaagggttaattatagtggagggatttcgtctggtgatataggtacatctccatttaatcagaattttaattgtaacacatctttgttaacaccttatgttaggagttggctagattcaggttcagatcggcagggcgctaatacctctacaaattggcaaacggaagcatttcagacaactgatggccggagttgtggtgcttttggagctcgtggtaattcgaactttttccctgattattttatccgtaatatttctggcgttcctttagttgttagaaatgaagatttaagaagaccgttacactataatgaaagaagaaatatatcaagtcctccaggaacacctgttggaggaagagcatatatggtatctgtgcataacagaaaaaataatatctatgatactcatgaaaacggtactatgattcatttggcgccggaagattatacaggatttactatatcaccgatacatgcaactcaagtgaatagtcaagctaatcaagcgcgaacatttatttctgaaaaatttggaaatcagggtgattccttaagggttgaacaaagcacctcaacggttcaatacacatttagagggaatggaaatagttacaatctttatttaagagtatcttcaataggaagttccactattcgagtttcaataaacggtagagtttatactgttcaaaatgttaatactactacaaataatgatggagtacttgataatggagctcgtttttcagatatttatatcggtaatgtagtggcaagtgctaatactaatgtaccattaaatataacacctacatttaacaccggtacacaatttgagcttatgaatattatgtttgtgccaactaatatcccaccactatat

SEQ ID NO: 166 - protein, 638 aa, Bacillus thuringiensis
MNNVLNSGKSSSCDPYNVVVHDPFSFQHKSLDTIQKEWTEWKRTDHSLYVAPIVGTVASFLLKKVGSLVGKRIMSELQNLIFPNGDVNLVEEILRTTEQFLNQRLSTDTFERVKAELEGLQRNVEEFNRQVDNFLNPNQTPVPLAIIDSVNTLQQLFLGRIPQFRLSGYELLLLPLYAQVANLHLSFIRDVILNADEWGITSEATLRTYRGYLKDYTKEYSNHCITTYQNAFRGLNTSLHDMLEFRTYMFLNVFEYVSIWSLFKYQSLLVSSGANLYASGSSIGSVPERTQTYTSQDWPFLNSLFQVNSNYILSGYSGFRLFAGTPNPGLPPGSTTIQALLGARVNYSGGISSGDIGTSPFNQNFNCNTSLLTPYVRSWLDSGSDRQGANTSTNWQTEAFQTTDGRSCGAFGARGNSNFFPDYFIRNISGVPLVVRNEDLRRPLHYNERRNISSPPGTPVGGRAYMVSVHNRKNNIYDTHENGTMIHLAPEDYTGFTISPIHATQVNSQANQARTFISEKFGNQGDSLRVEQSTSTVQYTFRGNGNSYNLYLRVSSIGSSTIRVSINGRVYTVQNVNTTTNNDGVLDNGARFSDIYIGNVVASANTNVPLNITPTFNTGTQFELMNIMFVPTNIPPLY

SEQ ID NO: 167 - DNA, 1902 bp, Bacillus thuringiensis
atgaatagtgtattgaatagcggaagaactaccactcgtgatgcgtataatgtagtggctcatgatccatttagttttcaacacaaatcattagataccatacaaaaagaatggacggagtggaaaaaaaataatcatagtttatatgtagatcctattgttggaactgtggctagttttctgttaaagaaagtgggaagtcttattggaaaaaggatactaagtgagttacggaatttaatatttcctagtggcagtacaaatctaatgcaagatattttaagagagacagaaaaattcctgaatcaaagacttaatacagacactcttgcccgtgtaaatgcggaattgacagggatgcaagcaaatgtagaagagtttaatcgacaagtagataattttttgaaccctaaccgaaacgctgttcctttatcaataacttcttcagttaatacaatgcagcaattatttctaaatagattaccccagttccagatgcaaggataccaactgttattattacctttatttgcacaggcagccaatttacatctttcttttattagagatgttattcttaatgcagatgaatggggaatttcagcagcaacattacgtacgtatcgagattacctgaaaaattatacaagagattactctaactattgtataaatacgtatcaaagtgcgtttagaggtttaaacaccagtttacacgatatgttagaatttagaacctatatgtttttaaatgtatttgaatatgtctctatctggtcgttgtttaaatatcaaagtcttctagtatcttccggcgctaatttatatgcaagtggtagttcaattggtagtgtaccagagcggacccaaacatatacttcacaagactggccatttttaaattcccttttccaagttaattcaaattatatattatctggttatagtggttttaggctttttgctggtacccctaatcctggtcttcctccaggctctactacaattcaagcattgcttggtgcaagggttaattatagtggagggatttcgtctggtgatataggtacatctccatttaatcagaattttaattgtaacacatctttgttaacaccttatgttaggagttggctagattcaggttcagatcggcagggccttaatacctctacaaattggcaaacagaatcctttgggacaactgcaggctcatggtgtggtgcttttacacctcgcggtaattcaaactatttccctgattattttatccgtaatatttctggcgttcctttagttgttagaaatgaagagttaagaagaccgttacactataatgaaagaagaaatatatcaagtccttcaggaacacctgttggagcacgagcttatatggtatctgtgcataacagaaaaaataatatttataccgttcatgaaaatggtactatgattcatttagcgccagatgattatacaggattcactatatcaccgatacatgcaagtcaagtgaataatcaaacgcgaacatttatttctgaaaagtttggaaatcaaggtgattcgttaaggtttgaacaaagcaacacgacagctcgttatacgcttagagggaatggaaatagttacaatctttatttaagagtatcttcaataggaaattccactattcgagttactataaacggtagagtttatactgctttaaatgttaatactactacaaataacgatggagttaatgataatggagctcgtttttcagatattaatatcggtaatgtagtagcaagtagtaatactgatgtaccattagatgtaaatataacattaaactccggcactcaatttgatcttatgaatattatgtttgtgccaactaatatttcaccactttat

SEQ ID NO: 168 - protein, 634 aa, Bacillus thuringiensis
MNSVLNSGRTTTRDAYNVVAHDPFSFQHKSLDTIQKEWTEWKKNNHSLYVDPIVGTVASFLLKKVGSLIGKRILSELRNLIFPSGSTNLMQDILRETEKFLNQRLNTDTLARVNAELTGMQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFRGLNTSLHDMLEFRTYMFLNVFEYVSIWSLFKYQSLLVSSGANLYASGSSIGSVPERTQTYTSQDWPFLNSLFQVNSNYILSGYSGFRLFAGTPNPGLPPGSTTIQALLGARVNYSGGISSGDIGTSPFNQNFNCNTSLLTPYVRSWLDSGSDRQGLNTSTNWQTESFGTTAGSWCGAFTPRGNSNYFPDYFIRNISGVPLVVRNEELRRPLHYNERRNISSPSGTPVGARAYMVSVHNRKNNIYTVHENGTMIHLAPDDYTGFTISPIHASQVNNQTRTFISEKFGNQGDSLRFEQSNTTARYTLRGNGNSYNLYLRVSSIGNSTIRVTINGRVYTALNVNTTTNNDGVNDNGARFSDINIGNVVASSNTDVPLDVNITLNSGTQFDLMNIMFVPTNISPLY

SEQ ID NO: 169 - DNA, 1803 bp, Bacillus thuringiensis
atgaataaaaaaatgggtaaaagcatagtactttcagaatggatgcggaaaatacctgattcatggacattagcccaaatgtctatcccaggaacccatgatagcggtacttttaagttaaaagatcctataaaagtaacatgggcaaagacacaagaccgtgaatttgatcaacaaatgcaaatgggtgtgagattttttgatattagagggcgtgtaactgatgacaatacaattgttctacaccacggttcaatatatctttatgtaacccttcatcaatttattaatactgctaaaagatttttaaaagatcatccaagtgaaacgattattatgtcactaaaagaagaatataaagcaatgccaggagcgaaagatacattcgtagatacgtttgaaaatagatactttaaagactctatctttttaaaaaaggagggaaatataacaatgggagatgctcgcgggaaaattgtactactaagaagatacgcgggcggtaagatgacagggggttataggaattttggatgggctgataacaaaacatttacttctactacaaatggaaatataaaagtaactgtgcaagaccaatacgatgttaaaaaagatgtaaagaaagatgcaattaacaacatgttaattgctacagcagccaatgatcttgatcctaatcacatccatattaactttacaagtttatcttctggtggtacagcatggagtagtcccttttattttgcctctcatttaaatagttggactgcggaaattgtgaagaaatcaggaagaaaagcaggctgggttattatggattatgttggagatgagtggaatccgaagctatattgggacgtaatagatactaactttaacctcccaaatagatataaaataaaaacagccttaaacggtacaagcggtgttgatgtttcagtcaatcgagatcaatatggtaataggaaagtacatttgtataatgataatttaactaaaagacatcaatgggatcttcagcatgatagcaattataaagcatttcaaatacatagtgttgaggaacctactaaagttttggcctggaatggtaatatggattcaaaaaatgtatttattacaaaaaatgagtataaagaagaatactattggacattagaagatgtaggaaatggttactatattataaaaaacttcaaaaatcctaatcttgtattggatgttaaaggcggtaaaacaaataacgatacccctattcaagtgtatgaaagaaatgaaacaaatgctcaaaagttcaaactaagccaagtaatcatacaaggtgtatataaaataaaaacagctttaaatggtacaagtggtgttgatgtttctagcgctggagataaaaatgtacatttgtatcgggacaattctgttacaagatctcactggaagtttcattataataaaaataaagacgcctatcagatcgtcaacatatactttgaaaacgaagtaatggcctggaatgattataagggaacaaaaaatgtatttgttacaaaaaatcagcataaagatgaacattattggagattagaggatgtagggaatggttattatgttataaaaaatttaaaagattcagaatttgtgttggatattgaatggagtaatacaaatgactttacaaatattcaggtgcataaaaggaatgaaacagatgctcaaaagtttaaattagttaaagtagatgtagatttagcaacattatatcatcagcaaaatccattagagcaagaatttgaaaataaatta

SEQ ID NO: 170 - protein, 601 aa, Bacillus thuringiensis
MNKKMGKSIVLSEWMRKIPDSWTLAQMSIPGTHDSGTFKLKDPIKVTWAKTQDREFDQQMQMGVRFFDIRGRVTDDNTIVLHHGSIYLYVTLHQFINTAKRFLKDHPSETIIMSLKEEYKAMPGAKDTFVDTFENRYFKDSIFLKKEGNITMGDARGKIVLLRRYAGGKMTGGYRNFGWADNKTFTSTTNGNIKVTVQDQYDVKKDVKKDAINNMLIATAANDLDPNHIHINFTSLSSGGTAWSSPFYFASHLNSWTAEIVKKSGRKAGWVIMDYVGDEWNPKLYWDVIDTNFNLPNRYKIKTALNGTSGVDVSVNRDQYGNRKVHLYNDNLTKRHQWDLQHDSNYKAFQIHSVEEPTKVLAWNGNMDSKNVFITKNEYKEEYYWTLEDVGNGYYIIKNFKNPNLVLDVKGGKTNNDTPIQVYERNETNAQKFKLSQVIIQGVYKIKTALNGTSGVDVSSAGDKNVHLYRDNSVTRSHWKFHYNKNKDAYQIVNIYFENEVMAWNDYKGTKNVFVTKNQHKDEHYWRLEDVGNGYYVIKNLKDSEFVLDIEWSNTNDFTNIQVHKRNETDAQKFKLVKVDVDLATLYHQQNPLEQEFENKL

SEQ ID NO: 171 - DNA, 999 bp, Bacillus thuringiensis
atgtaccaaatgaaaaataataaaaaattaggaaaaaaattattagctcttagtgcaatcgcatctatgggagtaacgtatgctactatatctccagaattggcaagtgctgctcaacttgatacaattcaaaaaacttcgcccattaatgaattcataggtgaaacaaaagcaatacaagactggcaaactcctttgactgaagctgaacttgtttatggaaagcatttagatagtcagcgaaaatataaattttcgaacggcgatgctaatcataatatgagggatattaagtttcatagtaatgcagtatcaccagatggtccacctaactttactgatgtaggggatgtatttgtaggacacgcaactttaaacaacgatcttgatgaaaaaatagatttaaaaacagatagtttctcaagaacgcttacagattctgttactacttctaccacacatgggtttaagattggagagaaaacaagtggtaaaatatcttttcccataggagaaatgtcgcaggaaatctctctagaatataatttttctactacggatagtcaaacaaatacagatagtaggacttatacaattccttcacaaactattcctgtcaaaccccattcttctgttgaagtaattgtcatgttaaaaagaagtaaggctacagggaatgtaaatctcttaactaaaatgtcaggaagagttgtaaattggaatcacagttattatcctttacctggtgaacagtatggtaaggcttatgtacatagtggttctatcgctagtatggttaagtatgcaaaaaacttcgagaaacttccaaatttatctgtgaacttagatgatacaatcaatttaattggtaaaggtacttatgaagctgaatttggtacagaatattcggtaactgtaaaaccaattgataaaaaagggaaatatacgggggaagattacacatataccgttaagccagaagttacaaaagcagaagcg

SEQ ID NO: 172 - protein, 333 aa, Bacillus thuringiensis
MYQMKNNKKLGKKLLALSAIASMGVTYATISPELASAAQLDTIQKTSPINEFIGETKAIQDWQTPLTEAELVYGKHLDSQRKYKFSNGDANHNMRDIKFHSNAVSPDGPPNFTDVGDVFVGHATLNNDLDEKIDLKTDSFSRTLTDSVTTSTTHGFKIGEKTSGKISFPIGEMSQEISLEYNFSTTDSQTNTDSRTYTIPSQTIPVKPHSSVEVIVMLKRSKATGNVNLLTKMSGRVVNWNHSYYPLPGEQYGKAYVHSGSIASMVKYAKNFEKLPNLSVNLDDTINLIGKGTYEAEFGTEYSVTVKPIDKKGKYTGEDYTYTVKPEVTKAEA

SEQ ID NO: 173 - DNA, 2172 bp, Bacillus thuringiensis
atgaattcaaataatcaaaatgaatataatgcttcatctactacttctgtatccaatgattctaacagatacccttttgcgaatgagcccacaaatgcgttacaaaatatgaattataaggattatttaagaatatctgagggttatgatagtgaatatttgggtacacctgaagtgcttattagtgagcaagatgcggttaagaaagcaatcagtctgttaggtacaatattaggaggtttaggggtcccattcgtgggaccgattgtgagcctatatagtacacttattgatgttttgtggccaggtggaaagagtcaatgggaaatttttatggaacaagtagaagcactcattaatcaaaaaatagcagaacacgtaaggaatagagcgctagcagatttagagggtttagggaataactaccaattatatttaacagcacttgaagaatggcaggaaaatccaagcagtacaagagtcttacgagatgttcggaatcgatttgaaatccttgatagtttatttacacaatttatgccttcttttcgggaaaaggattatgaagtaccattacttacagtatatgcgcaggcagctaaccttcatttactgttattaaaggatgcttcgatttttggagaagaatggggattctctacaaccgctattaataactattataatcgtcaaatgagtcttatcgcgcaatattctgatcattgtgtacaatggtatagaactgggttagatcgattaaaaggatcgaacgctaaacaatgggttgcatataaccgcttccgaagagaaatgacattaacggtgttagatattatgacgttatttccaatgtatgacacacgcacgtacccaatcgaaacgaaagcacaactaacaagggaagtatatacagatccaattggtgcaataggaccgcaagcatcttggtatgactcagcaccttcgttcaatactctggaaagtacttttataagaggaaagcatctatttgattttataactagactaaatatatatacagggagaagtttatgggatgctagtcattacttaaaaaaatggatagggcatcaaatatcctctcaacctataggcggcagtatacaaactcaaacctatggcactacgagtggcagttctgttattgctacgcagcaaattggctttacaggttatgacgtttataagactttatcaacagcgggggttctgtttgcttatacttcgaaatattatggcgtatctaaagttgtttttgatgcgatatatcctgacaacaagtataaaacaacattcacttataatcctggatctgaaggtattgcagcgcaagaaaaggattcagaagttgaattgccaccagaaacattagatcaacccaattatgaggcgtatagccataagttgaattatgttacatttattgaaaatccaggtgtaccagtattttcttggacacaccggagtgcggatcgtacgaatacagtttattcagataaaatcactcaaataccagttgtaaaggccagtgacggccctaaaccttccgctaacgaagttggacactatcttggtggagatccaatatcatttaactcttctggtagcactggagtgataaggttaaatataaattcaccattatcccaaaaataccgtgtgagaattcgctattgctcttcagttgattttgacttatatgtagttcgtggagacactactgtaaataatggtagatttaacaaaagcgcgcctagcgtcggatggcaaagtttgaagtatgaaaattttaaatttgctagcttttctacaccttttacatttaatcaagctcaagatacattaaaaataagtgtagggaattttagttcaatcgtagggggcagcacagtttatatagaccgaatcgagctcatcccagtaaatgcaacttatgaggcagaacaagatttagattcggcaaagaaagcagtgaataccttgtttacgaatacaaaagatggtttacgaccaggggtaacagattatgaagtgaatcaagcggcaaacttagtggaatgcctatcggatgatttgtatccaaatgaaaaacgcttgttatttgatgcagtcagagaggcaaaacgactcattcaggtacgcaactcgctt

SEQ ID NO: 174 - protein, 724 aa, Bacillus thuringiensis
MNSNNQNEYNASSTTSVSNDSNRYPFANEPTNALQNMNYKDYLRISEGYDSEYLGTPEVLISEQDAVKKAISLLGTILGGLGVPFVGPIVSLYSTLIDVLWPGGKSQWEIFMEQVEALINQKIAEHVRNRALADLEGLGNNYQLYLTALEEWQENPSSTRVLRDVRNRFEILDSLFTQFMPSFREKDYEVPLLTVYAQAANLHLLLLKDASIFGEEWGFSTTAINNYYNRQMSLIAQYSDHCVQWYRTGLDRLKGSNAKQWVAYNRFRREMTLTVLDIMTLFPMYDTRTYPIETKAQLTREVYTDPIGAIGPQASWYDSAPSFNTLESTFIRGKHLFDFITRLNIYTGRSLWDASHYLKKWIGHQISSQPIGGSIQTQTYGTTSGSSVIATQQIGFTGYDVYKTLSTAGVLFAYTSKYYGVSKVVFDAIYPDNKYKTTFTYNPGSEGIAAQEKDSEVELPPETLDQPNYEAYSHKLNYVTFIENPGVPVFSWTHRSADRTNTVYSDKITQIPVVKASDGPKPSANEVGHYLGGDPISFNSSGSTGVIRLNINSPLSQKYRVRIRYCSSVDFDLYVVRGDTTVNNGRFNKSAPSVGWQSLKYENFKFASFSTPFTFNQAQDTLKISVGNFSSIVGGSTVYIDRIELIPVNATYEAEQDLDSAKKAVNTLFTNTKDGLRPGVTDYEVNQAANLVECLSDDLYPNEKRLLFDAVREAKRLIQVRNSL

SEQ ID NO: 175 - DNA, 2037 bp, Bacillus thuringiensis
atgaattcatatcaaaatacaaatgaatatgagatattggatgcttcaccaagctattctaacatgacgaatagttatccaaggtacccactagcaaataatcgacaaggttcaatgaaaaatacgaactataaagattggttagctatgtgtgaaggaaatgcggaaggattttttttaactgatgaacaaatggtttctattgttggggctgcgatttcaaaacttcttggatttgtccctgtagttggagatattttaagtttcttggcggatacgtattggccaaaaattgcaggacaagagccagatacaagagtttgggcaggattgataagacatacagcaaatctaatagataatagagaagctgatagagtaatagggcaagcaactgctaatttaatgtcactctacggagctttaggtgtatataacagatttcttgagcaatggaaatcgcctgtaaagccgtatgccggccttgctgatgaagtacgagcacagatgagtactcttcacattctatttacgacaaaaattattagtgatttcacgatacagggttatgaatccatattactaccttcatacgcaagtgccgcgaatctgcacttactactattgcgcgatattgcaatttatgggaaaagtttaggttttgatccacaggttctgcaagcatatcataatgaacaagtgaaatttacaacagattatacggctcattgtataaagacgtacaatttaactttaaatgcacaaaaatcaaaaggttgggtagctttcaatcaatatcgtagggatatgactttgacagtactagatttaattgcattatttccaagttatgatacgcatagatatcctgtagatgaaaaaaatgtaaaaaaactatcaaaaacagaacttacaagagaaatttatacagcactaacagaatcttatcctagtaaaacagtagaagaaatggaaaaatctcttacaagagattctcatttattcacttggccaaagagattagatttctggacctttaattataatatgtacccagatacaagatacttatctgctaatagaattggtttttcatatacaaattcttctaaaatagaagatagtggaatttatggaagcactacttttggcacagtacttactcgtcaaattccgcttaattctaatgtttatagaacttctatcacagatactacattagtccctaatcaagttacaaaaatggatttctacaaaattgatggcactaatgaatcttataattcaaatataacgccagttcctgttaatttaagaaccacattttttggattctcatcagatgcgagcagaccacctaatcaaccaactgtacaagattataataatattttaagttatataaaaactgattttataggaggtcaccagggaagggtttcatttgcttggacacatagaggtgttgaccctaagaatcaaatactcacagataatgtcacacaagttccagctgtaaaatctagtttattaaatgcaccagctaaagtaattaaaggtccgggtcatacaggaggagatttagttgctcttctaaacaatggtactcaagccggtacaatgcaaatccaatgtaacacaggtagctttactgaaacttccagacgttatggtatacggatgcgttatgctgcaaataatgcatttacagtgagtctatcatatacattacagggggggaatccaataggtacaacatttgttacagaacgtacattttcaagaactaataatataataccaacagatttaaaatacgaggagtttaaatataaagagtataatcaaattattacaatgacttcacctcaaaatacaatagtaactataaatattcgacaactaaatccgtcttcaaatgatcaattaattattgacagaattgaatttattccgataactcaatcggtattagattatactgtggaacaaaatttagaaaccgcacaggaagtggtagacaatctattcataaat

SEQ ID NO: 176 - protein, 679 aa, Bacillus thuringiensis
MNSYQNTNEYEILDASPSYSNMTNSYPRYPLANNRQGSMKNTNYKDWLAMCEGNAEGFFLTDEQMVSIVGAAISKLLGFVPVVGDILSFLADTYWPKIAGQEPDTRVWAGLIRHTANLIDNREADRVIGQATANLMSLYGALGVYNRFLEQWKSPVKPYAGLADEVRAQMSTLHILFTTKIISDFTIQGYESILLPSYASAANLHLLLLRDIAIYGKSLGFDPQVLQAYHNEQVKFTTDYTAHCIKTYNLTLNAQKSKGWVAFNQYRRDMTLTVLDLIALFPSYDTHRYPVDEKNVKKLSKTELTREIYTALTESYPSKTVEEMEKSLTRDSHLFTWPKRLDFWTFNYNMYPDTRYLSANRIGFSYTNSSKIEDSGIYGSTTFGTVLTRQIPLNSNVYRTSITDTTLVPNQVTKMDFYKIDGTNESYNSNITPVPVNLRTTFFGFSSDASRPPNQPTVQDYNNILSYIKTDFIGGHQGRVSFAWTHRGVDPKNQILTDNVTQVPAVKSSLLNAPAKVIKGPGHTGGDLVALLNNGTQAGTMQIQCNTGSFTETSRRYGIRMRYAANNAFTVSLSYTLQGGNPIGTTFVTERTFSRTNNIIPTDLKYEEFKYKEYNQIITMTSPQNTIVTINIRQLNPSSNDQLIIDRIEFIPITQSVLDYTVEQNLETAQEVVDNLFIN

SEQ ID NO: 177 - DNA, 1137 bp, Bacillus thuringiensis
atgaaattactatcaaagaaaatcctgacagggttactcgtaggagcaacgagtctatctatctgggctcctgcaagtgaagcggctccagagaataatcgatattattctattaatttgaaagctaatcaaaacttagtttgggatggatggcaatttagtaatggtgctcagattcttttatatggtgcaaaccagggtgacaatcaacaatttgtattttttccacttgatggaggattatatgcaattgtaagtaaagagagtggaagacctgtagcatttggagatactaatgattacaatgctaatgacatattgatggaatatggttggactggtaacgctcgtcaaaaatggtatttacgagacaagggaagtaattattatgaaattgtaaaccaagaaaatgggaaagttgcatcttatgcgcggagggggctagggccagccgggacggagtatgtagatttagatcaaccaaatgcgtctgatccagataaggtattttacattgctaattctcgaagtggtttctcattaccaactttaccagctataggaactagaccaaatgctccagagtataatcctactggaggtattgatcaacaattacctcaaatttcaaattctgttgttgtgggggcatctttaataccttgtattatggtaaaggataatcaagcaagtgattatacaaaaatacacaattcaccatattatactttggaaaaagaagaatattgggataaaacattttcagcggttattccagctggtttgactcgtaattatacatttaaaacaggtatttcttctgtggatcaacaaaagatgactgatacgctttctatgaagattggagcagatttgggattgaaatttggagaaacaactgcagcacttaaaacagagattacaaaaacactacaaactgaaattagtacaactaatacggaagcaacggaagaaacaatttcaagtactgttacaagcgaacctggtaaaacaacaggatttacagaatatcagctggcaacaaaatatacgttaaagagagcagatggtacagttgtttcagatccttggattgtaaaaaacaacaagataacagtagcaagaaaaaaacaaata

SEQ ID NO: 178 - protein, 379 aa, Bacillus thuringiensis
MKLLSKKILTGLLVGATSLSIWAPASEAAPENNRYYSINLKANQNLVWDGWQFSNGAQILLYGANQGDNQQFVFFPLDGGLYAIVSKESGRPVAFGDTNDYNANDILMEYGWTGNARQKWYLRDKGSNYYEIVNQENGKVASYARRGLGPAGTEYVDLDQPNASDPDKVFYIANSRSGFSLPTLPAIGTRPNAPEYNPTGGIDQQLPQISNSVVVGASLIPCIMVKDNQASDYTKIHNSPYYTLEKEEYWDKTFSAVIPAGLTRNYTFKTGISSVDQQKMTDTLSMKIGADLGLKFGETTAALKTEITKTLQTEISTTNTEATEETISSTVTSEPGKTTGFTEYQLATKYTLKRADGTVVSDPWIVKNNKITVARKKQI

SEQ ID NO: 179 - DNA, 1143 bp, Bacillus thuringiensis
atgacattagctgtttcggatattgctgctgaattttcaatcattgatccaattttatataaaggagggataaatagggaaattttaacgaggaaaatatatacagacccagttattttctcgcctggcccttcaattgcagatgatgaaaatagatatacagtcccaccatcacctgttagaaaacttgtcggctcaacattatttagttctcagacgcctgctaatcctgatgaggagggtgagtttattggaaatcgaaaccgttatttaagtttagcaggtggagaatcatttgatggtcctctaatcggaaactcgacaaaccgttcgatacaagcaggaatcccgacaactgaatcggtttatgaagttggtgtaatgggtcgtagtgggtctccaaggattttaggtttgagatggggttcgttaactgactttcaaaagtttagtgctggaggagaagtgtataatttagttatgaatagggtctctgtgccaaataaaaaaaatgagccaataaataatactaattttactcatcgattatcagatataattcttcctggaaataggggctcatcttttgcatggactcatgttgaggtcgatcctacaggaaactatttatcaacaaatcagattaatttaatatctgctacaaaaatatctaacccaccactttcattacaaataagcaagggaccaggatttacagggggagatttagtcagatttccaaataatatcggagtttcttataagtttaagttcaaatccgatagctcagctaattttagaattcgtatacgttatgcaggtgcaggttcaggtgctagtggtggtggacgggtatattttaaattagggaattatagatctccagatactccttggggccatactggatttacctattccaatgtgaagtataatcaatttaaattattagagctttttggaactgcagaaaatattacaggcaacgacttggagattatagtattgacaggaggctcaggtgcttctgatttttatctagatagattggaattaatcccaatgacggggataccaacagaatacaatgaaccacaaaaattggaaacagccaaaaaagcagtgaccgatttgtttaccaat

SEQ ID NO: 180 - protein, 381 aa, Bacillus thuringiensis
MTLAVSDIAAEFSIIDPILYKGGINREILTRKIYTDPVIFSPGPSIADDENRYTVPPSPVRKLVGSTLFSSQTPANPDEEGEFIGNRNRYLSLAGGESFDGPLIGNSTNRSIQAGIPTTESVYEVGVMGRSGSPRILGLRWGSLTDFQKFSAGGEVYNLVMNRVSVPNKKNEPINNTNFTHRLSDIILPGNRGSSFAWTHVEVDPTGNYLSTNQINLISATKISNPPLSLQISKGPGFTGGDLVRFPNNIGVSYKFKFKSDSSANFRIRIRYAGAGSGASGGGRVYFKLGNYRSPDTPWGHTGFTYSNVKYNQFKLLELFGTAENITGNDLEIIVLTGGSGASDFYLDRLELIPMTGIPTEYNEPQKLETAKKAVTDLFTN

SEQ ID NO: 181 - DNA, 2112 bp, Bacillus thuringiensis
atgagacttacatcaaagttaaagggagtggtgtttacaatgcgacgtcaattaaaaaatgttagaaatataggaggaataactatgggtacagatcaaaatagaaatgaatatgaaatactggattctttaccttatcatgagtacacatcaaacagatatccgttcgcaaaaaatccaaacattatgaaaaacaccaattataaagattggttcaatgagggtcaagagactgaaccttctgcacttgtaagtacactgggcatcatgttcagtctctttagacaattcacatctttccttaggacgccttccgtgtctggtggagtagaaatactacgagagataataagtacaatacaggatcgttcagtaataaatcttactataaatgatgtccaacaacttattgatcaagcattagaaaatcatatcagaaatgaggcaaatcaaagatttaatagtatacaagccaattttaatcaatatctttccaataaaaatctctatttaaataatccttcggattcaacccgaaggctgtttgtaaatagccttagtgcaaatgagcgtgaattgaggatagcactagatgttacttttagcttggcaaatcgagaggtattattattgcccaattttacgcaaatcgcaatgttacatttaacaacattaaaagatgctgtaatatttagtggtccagacttaatagcacctacggttagtgaaacaactgggaattcttttttgaatcgacctcctagtaattcgtatgaagaggcacttttaactagcatacgtatgtattctaattattgcataagattctataatgaaggtttaaatcgcataagaaacaggggtacatctagtaatgtttggctggctttccataattatcgcagggaaatgacattaatagtattagattttgtcgcattgttttcactttttgatacaactaaatatccagcatcaagaaattttacaccaccagtagtttctcagttaagtagggtgatctatacggacccagtaggtgctataagaaccgatggtcgtgggtggtttgatccgcccgtaggaactgatgggactagggttaattttgcatcaatagaaaatgaaataccagcccctactacttctcggcatttatcggaattaacaatttcttcaggtcctcttggttttggcgtaaatccaagtaggacacactcgtggcaaggtaatcgaaatgttaatatatccgctcctactgatgtttctggagtaatttctaatcggacgcaaactattcctgctagaaatattttcagagtggattcacgtgtttatactcttgattggagattgtatggagtttatagagctgaattttttcaggatgctagtcaaaattctcaaaggcgtgtatttgcagaaaatcctccaacaggtgctggtgcccaaagcgcaaataactttcgatttttacctggagaaaattcggatacaccaactccgcaggattatactcatttattaagtagagtagtaaatgcaactgtaggacttacaccggcaacaggaaatcaacgtaattctgtattgatatttggttggacacataaaagtttaacctctgaaaatatatatagaatcaacgaaattacgcaagtagctgctgtgaatacaagaagtaattcgggtattcaggtaatttcaggacctggatttacaggtggagatttagtaagaatggaccctaatggtagcgtaagttacaattttacacccgctaaacagcaagcaggacaatcaaatctagcaatacgtctacgttatgcttgtcaagggaccgcttcattaagaataacgtttggcaatggttctagccaagtgattccacttgatgctacaacttcatcaataaaaaatcttcaatatgaagggcttcgctttgttgatgttccaaataatgttagttctctaccgactggtacttcaatgaccattcaaaatataagtacaaactctaacgtagtgctagatagagttgaacttttttccgacatacctattcccatttccgaagaaccaattattattccagggaattatcaaattgta

SEQ ID NO: 182 - protein, 704 aa, Bacillus thuringiensis
MRLTSKLKGVVFTMRRQLKNVRNIGGITMGTDQNRNEYEILDSLPYHEYTSNRYPFAKNPNIMKNTNYKDWFNEGQETEPSALVSTLGIMFSLFRQFTSFLRTPSVSGGVEILREIISTIQDRSVINLTINDVQQLIDQALENHIRNEANQRFNSIQANFNQYLSNKNLYLNNPSDSTRRLFVNSLSANERELRIALDVTFSLANREVLLLPNFTQIAMLHLTTLKDAVIFSGPDLIAPTVSETTGNSFLNRPPSNSYEEALLTSIRMYSNYCIRFYNEGLNRIRNRGTSSNVWLAFHNYRREMTLIVLDFVALFSLFDTTKYPASRNFTPPVVSQLSRVIYTDPVGAIRTDGRGWFDPPVGTDGTRVNFASIENEIPAPTTSRHLSELTISSGPLGFGVNPSRTHSWQGNRNVNISAPTDVSGVISNRTQTIPARNIFRVDSRVYTLDWRLYGVYRAEFFQDASQNSQRRVFAENPPTGAGAQSANNFRFLPGENSDTPTPQDYTHLLSRVVNATVGLTPATGNQRNSVLIFGWTHKSLTSENIYRINEITQVAAVNTRSNSGIQVISGPGFTGGDLVRMDPNGSVSYNFTPAKQQAGQSNLAIRLRYACQGTASLRITFGNGSSQVIPLDATTSSIKNLQYEGLRFVDVPNNVSSLPTGTSMTIQNISTNSNVVLDRVELFSDIPIPISEEPIIIPGNYQIV

SEQ ID NO: 183 - DNA, 2043 bp, Bacillus thuringiensis
atgtgggtgttattttataaaaatatatataaatttatcccaagttatttatatatagggggaatagatatggacccaaatgctaaatatgaaatcacgaatactaaatataatctatcacataagggcaataggtattcaagatttcctttagacaatactcagtatagaaaattgcaaaatatgaattacgaagatatgttgacagcttatcaaaaaaatgggaattttgcagagcttccaagtgtaacaagtgttgattggtcagctgcatcttctgcaatgataattgtagctggtactcttcttagcttatcgtctgctggtgtcggtgccggtattatatcaatcggaacattgctgcctttgttttggtctgatattgttgggaaaccaggagaaaatacatggcaaagtttaattgcacaaggtgatagcttatacgccgatcaaaatttaacacccgcttttttgcttacagtcaataacgaaataagcagggtacaggggtatttgagtttatttaatgatatttttaattattgggaaactaacgataaccctaataccagagattcagtacgtagggcatttgagaatgctaatgcagctattgtaggaagtatcaacataatttcaaatgcgacgggctataatatcatatctctttcttcctatacaaatctcgcgcttttccatttaaccctacttcgtcaaggagttttgaatgcagataagtgggggttaattcgagaggaaggagagttttacaagcaactgttaaaacagcgaatagacatgtatgttaattattgtcaatccacgtatcaaacaggtttggatcgcctcaaaactggaacgtttcttggtgcatggatctcttttaatacttatcggagagaatacactatttctgtactgaatattgctgcaacatttagtagttttgacctagacatgtatccctctaatttcgcgactactactcaaattacagaaaaaatccatgtaccaacacgtaatagtactgatacattttatgcgggttttccaaacctgaaaacactggaagagaagctgatacctacattaagtctatttaaagggttaacgagattgaatttttatacatccagtctaactggaataaaattcttgaatcaaattacaaattattacaattatataggaggaagatctgctggtactttaactaccacagggagtgatatttcctcacttccggatggtactgttgaaaatccttgggtgcacaaatgcgaatacgatcagatttggagccccgtgccccctttcagtccggattatgggatcaacaaacttacatttacttcgggaaatctaccacctaatgacgtttataatgcacatgtaccccttgtaaatacaaagacggtcactgtactaccacctataccacctctgccgccttctctaccaccaaacgtggtcccaattaaatatatattatctgatatgactacaattgatttaagaccgaatagcatgaatcttttatataattttagttggacggttgcaagtgctaatgctgataatgtgataaaaggaggggattatattacacaaatcccagcagtaaaaggcgatacacttagcaatggtgctaaagttagagaaggacctggccatacaggtggaccaatagtcgaattcggtccacatgtaccggcaacccctcccgcagtaaacataaagtgtaacgtatcaactgaagctgccaataaaaaccttgttatgaggattcgctatgcctcaagttcaaaaaatgccacgctcctaaacttaaatatagggggggaggttcataatagtatagtatgtacagggaccggggcggatataaaaaaaattgatataaagtacaatgagtttaatactactgacgaaatttcaatagtaaatcctaaaagtgctggatctatggatgtatatatagagaaagctagtaacatcaatgagacacttcttattgacaaaattgaattttatataaaaagt

SEQ ID NO: 184 - protein, 681 aa, Bacillus thuringiensis
MWVLFYKNIYKFIPSYLYIGGIDMDPNAKYEITNTKYNLSHKGNRYSRFPLDNTQYRKLQNMNYEDMLTAYQKNGNFAELPSVTSVDWSAASSAMIIVAGTLLSLSSAGVGAGIISIGTLLPLFWSDIVGKPGENTWQSLIAQGDSLYADQNLTPAFLLTVNNEISRVQGYLSLFNDIFNYWETNDNPNTRDSVRRAFENANAAIVGSINIISNATGYNIISLSSYTNLALFHLTLLRQGVLNADKWGLIREEGEFYKQLLKQRIDMYVNYCQSTYQTGLDRLKTGTFLGAWISFNTYRREYTISVLNIAATFSSFDLDMYPSNFATTTQITEKIHVPTRNSTDTFYAGFPNLKTLEEKLIPTLSLFKGLTRLNFYTSSLTGIKFLNQITNYYNYIGGRSAGTLTTTGSDISSLPDGTVENPWVHKCEYDQIWSPVPPFSPDYGINKLTFTSGNLPPNDVYNAHVPLVNTKTVTVLPPIPPLPPSLPPNVVPIKYILSDMTTIDLRPNSMNLLYNFSWTVASANADNVIKGGDYITQIPAVKGDTLSNGAKVREGPGHTGGPIVEFGPHVPATPPAVNIKCNVSTEAANKNLVMRIRYASSSKNATLLNLNIGGEVHNSIVCTGTGADIKKIDIKYNEFNTTDEISIVNPKSAGSMDVYIEKASNINETLLIDKIEFYIKS

SEQ ID NO: 185 - DNA, 2103 bp, Bacillus thuringiensis
atgaattcaaataataataatgaatacgaaattattgattcaaacacttgcccttatccacctaacagaaagaatgagtatactaaatatccttatgcgaataatccagagcaatatttgccaaacatccctcttgaaaaatggctcagtgatcctcaaactagaataacaacaactctttctataataggcgctattactgaattaatgatagcttcatattttggtccgggtgtatttatagtagctgggacagctattatgtcagacttaatacctcttatttgggataatttacaagaaaatcttcctagtggacttataaatgtcacacaagaaatgcttaatacacaactagacgaatatacttatacccaagcaatatatcgatataaaggtttaatagatggttttaaccaattcaagctatattttaacgcgtggaaaaataaccctaatgattttaacaaaatatcagatgtatcaggttattttagaactttaaatggtacatttaatactacaatggctacatttcaacaacaaggttatgaacacatactattaccagtttatgcacaagctgcacaagcacatttacttcatttacgtgatggtatttcatatgctgataaatggaatctaggaagagcaaattatgattcaggagatactcattatcaagaattcatagatgcttgtaaaagatacacaaaatattgtacagagtggtattataaaagtttagacatttttaaaagtaaaaattcaaactggtctgactataatctttaccgtagatttttaacaattactgtgttagatattatttctatgttttcatcttacgatgcacgtttatactctatcccatcaaaagtagaaattcttacaagaaaaatatatgcagatccaattaattattctcaaggtaattctctagcagaagatgaaaaaaatcatacggtagataacctaagattatttactcaattaaataaactagaaattagtagtgatatacaaaatggttttaacggggttactaatttttatagatttttatcacccggcaacagttcaatatcacatttttctggaacaccatttcaatatataagtacagtaccttacactttttatcctactaatgaaacatctttttataaaattaaaacatttaatattaaccaacctagtgctacattagatgcaatagatataatgtatttttatatgtgggatggaaaacaagagcacatacaaagaatacttgcaagtacatctggtaacgaaacaaatgcaaaatacgtttatatagctggaaaaaaagatttaaaagatgaaaaaaatagttacagaccaaatgattttaattcattaaattatcataattctactcatgtcttatcagatatgattgtaaatacagccaataaaaatgcaattagttactcttttgcatttacaaataaatctatttcttttagcaatacaataaaaaaagatgtaattaccttcatcccggcagtaaaatgttttcaaatgagttctaatgtaaaagttgtggaaggacctggtcatacaggagggaatttaataagattgcaaggcaatatgatgttcggtattacatttgctgatgatttgaatcaactttacagaatacgtattcgttatgccagcgacacgaacttgaggctttcactcggtatgatatctacccaagctatcaatattggtagaacttttttcaatttaagttctaataatttacagtatgaacattttgaatatgctacatttcaaacagtaattgtaccttcacctggggcaaatcaattagtacttttagaaggttttaacgatagcaatattaatttatatatagacagaattgaatttattccagtaacgcaacaatacttagaaacaagtgaaagagaaaaagtagaaacgattcaacaaaaaatgaatgatgtgtttttagatcctcaacatcaatttttacaaacaaaaacaacagattatgagattgatcaaatcgcaagtgacatagaaacaatatcagaagaatggtatccacaagaaaaaatgatgtta

SEQ ID NO: 186 - protein, 701 aa, Bacillus thuringiensis
MNSNNNNEYEIIDSNTCPYPPNRKNEYTKYPYANNPEQYLPNIPLEKWLSDPQTRITTTLSIIGAITELMIASYFGPGVFIVAGTAIMSDLIPLIWDNLQENLPSGLINVTQEMLNTQLDEYTYTQAIYRYKGLIDGFNQFKLYFNAWKNNPNDFNKISDVSGYFRTLNGTFNTTMATFQQQGYEHILLPVYAQAAQAHLLHLRDGISYADKWNLGRANYDSGDTHYQEFIDACKRYTKYCTEWYYKSLDIFKSKNSNWSDYNLYRRFLTITVLDIISMFSSYDARLYSIPSKVEILTRKIYADPINYSQGNSLAEDEKNHTVDNLRLFTQLNKLEISSDIQNGFNGVTNFYRFLSPGNSSISHFSGTPFQYISTVPYTFYPTNETSFYKIKTFNINQPSATLDAIDIMYFYMWDGKQEHIQRILASTSGNETNAKYVYIAGKKDLKDEKNSYRPNDFNSLNYHNSTHVLSDMIVNTANKNAISYSFAFTNKSISFSNTIKKDVITFIPAVKCFQMSSNVKVVEGPGHTGGNLIRLQGNMMFGITFADDLNQLYRIRIRYASDTNLRLSLGMISTQAINIGRTFFNLSSNNLQYEHFEYATFQTVIVPSPGANQLVLLEGFNDSNINLYIDRIEFIPVTQQYLETSEREKVETIQQKMNDVFLDPQHQFLQTKTTDYEIDQIASDIETISEEWYPQEKMML

SEQ ID NO: 187 - DNA, 2052 bp, Bacillus thuringiensis
atggacccaaatgatcataatgaatatgaagtcatggatactggcagcatgggctatcagccaaggtatcctcttgcgaatgcacctggtgctgaattgcaacagatgcattacaaagattggatggatatgtgtgaagatggagagtcaggagaaacgtttgcagaccttacagttcaggagggagtcactatagctgtaagtattgcagcggccgttcttagtgtatcatttccagtaacatcagcgggattaagtattatctctgtactcattccatactggtggccggagacagcaggaactcccggtactccctctgcgcaagttacatgggaaaaatttatgagtgctgcggaaattctcagtaataaacaaattgtagcgagtaaacgatcagatgccattgctagatggcaaggtatacaaacccttggaagagattattttcaagcacaatgtgactggctacaagatcaaaataatgaactcaaaaaaagtaaattacgggatgcatttgatgacgtcgaagattatttaaaagtgtcaatgccattctttggtgcgcaaggctttgaaattcccatgttagctatgtatgcacaagctgcgaatatgcacttaattttgctacgagatgttgtccagaatggtttgaattgggggttccagcaataccaagttgaccgatattattccaatacagacccttttttagggaaccctggactattacaactaatagaaggatatacggaatattgtgtacaatggtataatacaggtttacgacaacaatatgaaaataatagatacaattgggatgcattcaatgatttccgtagagatatgaccataatggtattagatattgtagctttatggccaacttatgatccgaagcgctatcccctacctacaaaatcacaacttacacgaactgtgtataccgatttaataggttattctggagatttcgaataccaacaaatagctattgaacgtgcagaacgagagctagtccagaggcctggtctatttacctggctgcgtgagataattttcaagctgctattaccgaccgtaaataattctttagcaggaagagaaatggtcttcaattataccgcaagtcccgatgggtatgaagagaacaaggggaatcccggacaaactagagagactcttgttattccagcaccggatgtaaaagatgacatctggaggattggcactcaaatttactaccatcctttatataatgttaataccgttgagggctggagtttttcttttactcgatcattagatcaaaaaatacattggatgtcaaatccttcatatagaacagtgatgcaaggattgtcttgtcacggaccttctatggattcttgtaacctttgtagcagtaatagtccatgtagaagtattactcctaactatagcctcccttgtaatgacaaggaggtctatagtcaccgattttcatatttaggggccggacttaaatccgacttaacaacgttgacttattttagctacggatggacccacatcagcgcagacttcaacaatctgatagatgctgaaaaaatcacccaaattccagcagtcaaggcatcttcaataagtggcaatgctagggtaatacgaggacctggaagtacgggaggagatttggtggaattttctaccgaaactacaggagggacactgaacatacgttacacaccgccggaagggacaagcagatatcagttaagattgcgttatgcaagtaatgtagacaacactaccatcacagttgacgggagaggacgtacttatgcggatattactacaaccgacattacaaatcttacgtatgataaatttggctatgtaaatatcaactatattctgggtcatactgatcggccatcagacgctctatcgtggttttccctcggagtttcgggtactggttcaggaacattccttctcgacaaaatcgaattcattccaatagaaggatcggtggaagaatttgaagcgaaccaagcattagaaaaa

SEQ ID NO: 188 - protein, 684 aa, Bacillus thuringiensis
MDPNDHNEYEVMDTGSMGYQPRYPLANAPGAELQQMHYKDWMDMCEDGESGETFADLTVQEGVTIAVSIAAAVLSVSFPVTSAGLSIISVLIPYWWPETAGTPGTPSAQVTWEKFMSAAEILSNKQIVASKRSDAIARWQGIQTLGRDYFQAQCDWLQDQNNELKKSKLRDAFDDVEDYLKVSMPFFGAQGFEIPMLAMYAQAANMHLILLRDVVQNGLNWGFQQYQVDRYYSNTDPFLGNPGLLQLIEGYTEYCVQWYNTGLRQQYENNRYNWDAFNDFRRDMTIMVLDIVALWPTYDPKRYPLPTKSQLTRTVYTDLIGYSGDFEYQQIAIERAERELVQRPGLFTWLREIIFKLLLPTVNNSLAGREMVFNYTASPDGYEENKGNPGQTRETLVIPAPDVKDDIWRIGTQIYYHPLYNVNTVEGWSFSFTRSLDQKIHWMSNPSYRTVMQGLSCHGPSMDSCNLCSSNSPCRSITPNYSLPCNDKEVYSHRFSYLGAGLKSDLTTLTYFSYGWTHISADFNNLIDAEKITQIPAVKASSISGNARVIRGPGSTGGDLVEFSTETTGGTLNIRYTPPEGTSRYQLRLRYASNVDNTTITVDGRGRTYADITTTDITNLTYDKFGYVNINYILGHTDRPSDALSWFSLGVSGTGSGTFLLDKIEFIPIEGSVEEFEANQALEK

SEQ ID NO: 189 - DNA, 1110 bp, Bacillus thuringiensis
atgaatgggagcaagatcaattttatgaaatttatagtccccattagacaaaaaatagtaattcgtaatgctgacacaaaaaatggtactgatgttattcaatataacagtggagaagataatgcaagatttattttatataaagttgatggtgataattatcttattgtaaataaaaacagtgggaaattagtagtagtttataattctgatcctggtaatgatgttggtatcaagcaatgggatagtgaaagtggaaatggaagatggcattttgtgaaaaatggtgggaattcttatttaattcgtagtaatatgagtgggaaattagcagtaattgaaaacggtagtaaaaataatgctgctttaattgttcaatatgatcaacaaagcgtaggaaacggagaatgggaatttcatccggttgagagctttactatgcccactttacctgaacttaaaccacagccatcttctcctgtatattcagaatcaggtggtgaaggtcaagcaatgcctgatacttcggaaaaagctgttgtagccgctactctttttcctgctgttatggttagaaataacagttggagtttatcaacacaaatgagatatagcccgtattatattttagaaaaacaacaatattggaaaaaagttgtgaatttatcatttgctccaggggaatcaaaaacaactacgtataaatatggaatgagagaaaccgatcaaacaactatgcataatacaatcagtatgactgttggcatggattctggtgtgaatattgaaggtgttacggaatctatgaaaggagagattacaaattcgttagaaataacagaaagtcatactactgaattaatgaaagattatgatgaaacaattaccataagtaatccatttcaaaaacaatctatgcaatatgcaaaatatatccttactactgaatttgttttgaaacgtacagatggttctgttgcagattcatggtctatgactgataataatacagttcatacgacttcatatccaagaatgtcagaagatacaagatttacaatagaatcacaatctaattctcaatcttgtaataattcaaaaccgtgcaaa

SEQ ID NO: 190 - protein, 370 aa, Bacillus thuringiensis
MNGSKINFMKFIVPIRQKIVIRNADTKNGTDVIQYNSGEDNARFILYKVDGDNYLIVNKNSGKLVVVYNSDPGNDVGIKQWDSESGNGRWHFVKNGGNSYLIRSNMSGKLAVIENGSKNNAALIVQYDQQSVGNGEWEFHPVESFTMPTLPELKPQPSSPVYSESGGEGQAMPDTSEKAVVAATLFPAVMVRNNSWSLSTQMRYSPYYILEKQQYWKKVVNLSFAPGESKTTTYKYGMRETDQTTMHNTISMTVGMDSGVNIEGVTESMKGEITNSLEITESHTTELMKDYDETITISNPFQKQSMQYAKYILTTEFVLKRTDGSVADSWSMTDNNTVHTTSYPRMSEDTRFTIESQSNSQSCNNSKPCK

SEQ ID NO: 191 - DNA, 1974 bp, Bacillus thuringiensis
atgaattcatatcaaaatcaatatgaaatattggagtcttcatcgaataacacaaatatgccaaacagatatccttttgcaaatgatccaaatatattccctattaacctggacgcttgtcagggaaggccatggcaagatacgtgggaatcagtctcggatatagtaactattgggacataccttatacaattcttgctagaacctggtataggtggaattcctgtaatattgtcaataataaacaaactcattccatcttctggtcaatctgtggcaacactttctatatgtgatttattatctataattcgtaaagagatagatgtgaatactttaaatcgtagagctgcagattttaacggtgcattggctgtccatagaaagtattatcttgcttctcttcaggagtggcttgatgcaggccaaccaaaggacccagcaaatcagaaacttaagaatgtagttagggatttcatagatgcggacaaagcattcattgcacttatagaaggggggctatcagaaagtaaagctcaaatattattattgcctatttatgcacaagctgcaaatgtgcatttattactattaagagatgcagttcaatataaagaaaaatggggaggattattgggggcggagaaagtaggagaggaattaatatcacctactatggattataacaagcgattaaaagatgcgatagaacagtataccaattattgtgtagagtggtataacaagggtttagatcagataaaacaggcaggtacaagtactgaaacctggttgaaatttaataaatttcgtagagaaatgactttggcggtattggatgttattgctatatttccaacttatgattttgaaaaatatcccttagcaacaaatgtagagttgactagggaaatttatacagatccagtggggtattcaggaagcagtattcgttgggaacggacttttcccaatgcttttaatacgctagaagctaatggaacacggggaccgggtttagttacttggcttagcagtataagtatatatagtcagtattttacggtttattttagcggttgggtaggaactcttcatgctgaagattacacaaggggtaacggtactttctatcgtttatctggaactactacgagtaatgatccacgtaatttgctttttagcccttccgatatatttaaaattgtttcattaggtatctatgaaacaagagcagagcttggatacacacggcaacggttttgtgtttcacgtgcagaatttagtacgtcaacaccatataaatacctgtatgatgaaaataataatggacaaggccgaatgacaattgaatctacgttaccaggtattgagaatctagaacctagttatacaaattactctcatagattatcaaatgcggcatgtgttcaatttaacgactccagagttaacgtatatggttggacacatataagtatgaaaaaaagtaatactatttatccagataaaatttcacaaataccggctgtgaaagcatttgctttagaatcaggcgcttatgttagcgctggacctggtcatacaggaggaaatgtagtatggttaccatatttagggcgtttaaaaatacgtttaacttctgcgcccacgaataaaaattaccgtgttagagttcgctatgcaggtttgtactcaggtcgtttaatggtacaaagatggtcgctgagtgggtctgcaactggtgattttccttattcatctacgggttctaataatacatttggatatgtggagaccttagttactacatttaatcaatcaggtgttgaaataattatacaaaatcaaacttctccacaacttatcattgacaaaattgaatttatcccaattgatctaacaactttagaatatgagggagaacagggcctagaaaaaacaaaaaacgcggtgaacgatttgtttatcaat

SEQ ID NO: 192 - protein, 658 aa, Bacillus thuringiensis
MNSYQNQYEILESSSNNTNMPNRYPFANDPNIFPINLDACQGRPWQDTWESVSDIVTIGTYLIQFLLEPGIGGIPVILSIINKLIPSSGQSVATLSICDLLSIIRKEIDVNTLNRRAADFNGALAVHRKYYLASLQEWLDAGQPKDPANQKLKNVVRDFIDADKAFIALIEGGLSESKAQILLLPIYAQAANVHLLLLRDAVQYKEKWGGLLGAEKVGEELISPTMDYNKRLKDAIEQYTNYCVEWYNKGLDQIKQAGTSTETWLKFNKFRREMTLAVLDVIAIFPTYDFEKYPLATNVELTREIYTDPVGYSGSSIRWERTFPNAFNTLEANGTRGPGLVTWLSSISIYSQYFTVYFSGWVGTLHAEDYTRGNGTFYRLSGTTTSNDPRNLLFSPSDIFKIVSLGIYETRAELGYTRQRFCVSRAEFSTSTPYKYLYDENNNGQGRMTIESTLPGIENLEPSYTNYSHRLSNAACVQFNDSRVNVYGWTHISMKKSNTIYPDKISQIPAVKAFALESGAYVSAGPGHTGGNVVWLPYLGRLKIRLTSAPTNKNYRVRVRYAGLYSGRLMVQRWSLSGSATGDFPYSSTGSNNTFGYVETLVTTFNQSGVEIIIQNQTSPQLIIDKIEFIPIDLTTLEYEGEQGLEKTKNAVNDLFIN

SEQ ID NO: 193 - DNA, 2085 bp, Bacillus thuringiensis
atgggaggaacatatatgaatccatataacaatgatggctatgagattattgattcaaagacttcaccttatcctgctaacagaaataattcatattcgaattctagatatccttacattaataatcctaatcaacctatgtcaaacactaatcacaaaaattggatgaatctatgtgaagaaaatgaagcatatgatctaagtcctgaaacaattgctgcaattggtgcaggaattattgtagttggtactatgataggtgcttttgctgctcctgtcgcagctggtgctattatatcatatggaactttattgccaattctttggccatcaccaaacgaccaaaccatctggcaacaacttgtaaaaattgggaataggccttctaattcagaaatagatcaagcaataataaaccatttacttactgtagtaaatggtttaaaagctcaatttacagactatcaaagttactttgatatatggaaagcaaacccttcttcaataaatgctgatgcggtaagaaataaatttctttcattagatagtgatataataagagagatagaaactttaaaaggaaataatagtataatactcctcccttcttatacacaagtagctaatttgcatttaattctattacgacaagcagcattctattatgatgattgggttaaattcttaccacatactaatatttcttctgacttctacgctggaaaactaaatgacaaaatagcggaatatactgattattgtttcagaacataccgtgaaggactgtattcaattgaacagaactctcaaacaacatggaacttatataacacttatcgtaatgaaatgaccctcacagtattagatttagttgcactttttcctaattttaatcgtaataaatataatttaccgactaaatctcaattaactcgagaaatttacactaatactaatttagaaataaataaatctatagtagaaaccgaacgaggattaactagaaaccctacattattcactagaatacaatcagctgactttttcagtagaaagtatgatatcgttggcgattattcgacaatgcttacaggcaaccaggtaagttttaactatataaacagtaacaaagcacctataaattcctctatttatggagatgttaaccaaggcaattccagtaaaacagtcacatttaaccaacctattgatatggttaaactagaacacaatcaaaattttcgaggatatatattgagaattatatttttttcaaataacatagaggtagctcgatattcttctgggtccacattaccatctgaaagaataaaaactatcgtttatacaattccgagaaaagaacttaataccaatgaatattatcataccttatcttatatcaaaactgataataatacagcacctcatgatggaaaatacagaagtgttgcatttgcttggacccatagtagtgttgattctaataatacaattttcccaaatgaaattacccaaatccctgctgtaaaagcatttcaaattagtaatgattcaaaagttgtaagaggtcctggttttacaggtggagatttagtagttctaaaacacagtattgattttaaacttaggacacctacaagtaatccttcttcttatcaagtacgtgttcgttatgcttctaatgcaagtacacaaataattatgtcattaacaaccggtaacatacccgtaacatttccaagaactgtaactcattcaattgttggtaatttacaatacaaagattttcaacatgtcacattcccaaaaccattgttaataaatagaaacccaggagaagacatattattgagcttactaggtatacaaaatgatccatttaacatctggatagataaaatcgaatttattccggtaacgcaacaatatttagaaacaagtgaaaaagaaaaaatagaaacgattcaacaaaaaatgaatgatgtgtttttagatcctcaacatcaatttttacaaacaaaagcgacagattatgagattgaccaaatcgcaaataacatagaaacaatatcagaagaatgg

SEQ ID NO: 194 - protein, 695 aa, Bacillus thuringiensis
MGGTYMNPYNNDGYEIIDSKTSPYPANRNNSYSNSRYPYINNPNQPMSNTNHKNWMNLCEENEAYDLSPETIAAIGAGIIVVGTMIGAFAAPVAAGAIISYGTLLPILWPSPNDQTIWQQLVKIGNRPSNSEIDQAIINHLLTVVNGLKAQFTDYQSYFDIWKANPSSINADAVRNKFLSLDSDIIREIETLKGNNSIILLPSYTQVANLHLILLRQAAFYYDDWVKFLPHTNISSDFYAGKLNDKIAEYTDYCFRTYREGLYSIEQNSQTTWNLYNTYRNEMTLTVLDLVALFPNFNRNKYNLPTKSQLTREIYTNTNLEINKSIVETERGLTRNPTLFTRIQSADFFSRKYDIVGDYSTMLTGNQVSFNYINSNKAPINSSIYGDVNQGNSSKTVTFNQPIDMVKLEHNQNFRGYILRIIFFSNNIEVARYSSGSTLPSERIKTIVYTIPRKELNTNEYYHTLSYIKTDNNTAPHDGKYRSVAFAWTHSSVDSNNTIFPNEITQIPAVKAFQISNDSKVVRGPGFTGGDLVVLKHSIDFKLRTPTSNPSSYQVRVRYASNASTQIIMSLTTGNIPVTFPRTVTHSIVGNLQYKDFQHVTFPKPLLINRNPGEDILLSLLGIQNDPFNIWIDKIEFIPVTQQYLETSEKEKIETIQQKMNDVFLDPQHQFLQTKATDYEIDQIANNIETISEEW

SEQ ID NO: 195 - DNA, 930 bp, Bacillus thuringiensis
atgattacaaacatagagcagtcaacgataaattatatgaaatggtatgcaataaattatctaaatgcagaacctacaactttttttacagaagggatatatccatacgaggttcaaaatattagtatcaacccaaaattaaataatttttttgtaaatacctttccaaaagaagaatactttcaagtaattgaaaataatacagatacaaatcaacttcaaaacatcaaattttctgaaaaatctatcgaaactattactaatactactactttagggtatacactttataaaggaataaagttatctactacatttaatattctagtcaattttatgatatcaggtagtattgaacaatctcttgaaattccatttaattccgaatttaaatgttattctactgaaacaacaaagaaaacatttaataaactttgggaatttacccaacctgtaattgtacctccccatacgcgaattactgcaactcttataattatgggagcgaccataaaaattcctactcaattatcagctaatattaacggagctcatatgtataacaacaaagagaattggttctcttcaatttcatttcgacaatttaatggttcaaaggtcaagacattatttgctgcaagtaatttaagccaaaattcttggcctaaaaaaccatcaatctttgcttctccaggaccacatggttcactaaatttaagaggcgaatcaattattactgttgaaccaggtttatatactgttgctaaatttgttgaatcaccattagatggattttcaaatgaaagaaaaacttggtatacagataaagtaatattacgagatggaagaatgattcaactaccaaatttaaatccgttaactggaaaatcaagttttattgatactgaaataattcttattgaggataaa

SEQ ID NO: 196 - protein, 310 aa, Bacillus thuringiensis
MITNIEQSTINYMKWYAINYLNAEPTTFFTEGIYPYEVQNISINPKLNNFFVNTFPKEEYFQVIENNTDTNQLQNIKFSEKSIETITNTTTLGYTLYKGIKLSTTFNILVNFMISGSIEQSLEIPFNSEFKCYSTETTKKTFNKLWEFTQPVIVPPHTRITATLIIMGATIKIPTQLSANINGAHMYNNKENWFSSISFRQFNGSKVKTLFAASNLSQNSWPKKPSIFASPGPHGSLNLRGESIITVEPGLYTVAKFVESPLDGFSNERKTWYTDKVILRDGRMIQLPNLNPLTGKSSFIDTEIILIEDK

SEQ ID NO: 197 - DNA, 2136 bp, Bacillus thuringiensis
atgaatccaaattataacaagaatgaatttgaaatattaaatagtagtagcctgatcacagggcgaagatatccccttgcgaaggcaccagattctgaattacaacagatgaattacaaatattggatgaataagtgtgcaaatataacgcaaccgatgtctctagtcccctcgggcggactagttcttaaagaaggtgcgactttagtaacggggatagtggctattatgctagccactacgtttccgttgactgcggccgcatttggacttatttctgtactattagcatttctgtggccgttgctcgaagaacctgaagctcccgactcgcaaatatcatgggaagtacttatggctgctgcagaagaacttatgaatgacaaaattgcagatcttcaaaaaacgagagctctttctcaattacggattgtacagtcaaggctaaatgactataaccaggccctctgtaatttagaattagatcccaataatgaatcgaataaagcggaagtaagagatgcatttgatgatgccgatgatgcattgaaaagtgctatgataatctttagcgaaaaaccctacgaaaagctcatgttaaccagttacgtgcagggtgccaatctgcatttacttttattacgggatgttgtgaaattcggagaaagctggggatttacaccaattcgcgttcaacaatactattctaacgtgaatgtaggaaaccctggtatgctacaactattagaaaaatatacagatcattgtatggatacttaccatgcgacagctcccccagctccccctatcaacacggacagtgagtactatgagtatcgtacgaatatgattattatgctgttagatgttgtagcattatggccaacatatgacccgaaattatatccatattatgtaacatcacaattgacgcgagaagtgtatacacgtccaatagggtactcttataactatcatcgattagaaacatgggatcgtccaccttctttatttcagtggttgcgtgatataacattttatactcaaccgacaaagtgggtaccgggtacccctgcaacttattatgttacgcagtatactggtttgcaattaacgtatcaccacaccctgaatgatgcattaattgaacctccactagtgggatggtggagtgatagtttgaattctattaaatgggatgttaaaattaatcccgatcaggatatgtatatggttaggaatcacttccagggagggtttaggggtgacctggagcagtcacctataacacaattcttctttcatactagtccttacaacgaaattacaacggtcggaaaatctttggatgtagatactcctccagagttttcatatggactatcttgtctaaatagtcctaatgaatcttgtggtatttgtactccttgtgaattgagtaatgtcaatcgagaaattccttgtgagggccctagtctttatagtcatcgattgtcgtggattagtacggtagaagagcgtgattataattatgggttttcttttcccggctcagtaataagcgcgtttgcttacggctggacacatgtaagtgcggataaaaacaatatgctagaccttgaaaaaatcacccaaatcccagcagtcaaggctaaagatttattaggcgatgcgagggtaatcaagggacctggtagtacaggaggagatttaatacagctagtgtctcagggatttggcgatccggtaccgaatggtggaagttttgttattcaggtacagataccaataaaaaaagcgtataaaatacgatttcgttattcagctccactatataccaatataagagttaccgggtatgatgcgaagaacacagtaatatacgtagattatgcgaatgttgattccacatattatattgaaggaacagcattgacatacaagaatttttcttatattgacctgaatgcgccgttagattctctttccacggatgtaacattggaattcggcttcgactctggggctcaacctggtgaatctatcatcattgataaaatcgaattcattccaattgaaggttccctagaagcatatgaagcagatcaagcattagacaaagcatggaaggcagtg

SEQ ID NO: 198 - protein, 712 aa, Bacillus thuringiensis
MNPNYNKNEFEILNSSSLITGRRYPLAKAPDSELQQMNYKYWMNKCANITQPMSLVPSGGLVLKEGATLVTGIVAIMLATTFPLTAAAFGLISVLLAFLWPLLEEPEAPDSQISWEVLMAAAEELMNDKIADLQKTRALSQLRIVQSRLNDYNQALCNLELDPNNESNKAEVRDAFDDADDALKSAMIIFSEKPYEKLMLTSYVQGANLHLLLLRDVVKFGESWGFTPIRVQQYYSNVNVGNPGMLQLLEKYTDHCMDTYHATAPPAPPINTDSEYYEYRTNMIIMLLDVVALWPTYDPKLYPYYVTSQLTREVYTRPIGYSYNYHRLETWDRPPSLFQWLRDITFYTQPTKWVPGTPATYYVTQYTGLQLTYHHTLNDALIEPPLVGWWSDSLNSIKWDVKINPDQDMYMVRNHFQGGFRGDLEQSPITQFFFHTSPYNEITTVGKSLDVDTPPEFSYGLSCLNSPNESCGICTPCELSNVNREIPCEGPSLYSHRLSWISTVEERDYNYGFSFPGSVISAFAYGWTHVSADKNNMLDLEKITQIPAVKAKDLLGDARVIKGPGSTGGDLIQLVSQGFGDPVPNGGSFVIQVQIPIKKAYKIRFRYSAPLYTNIRVTGYDAKNTVIYVDYANVDSTYYIEGTALTYKNFSYIDLNAPLDSLSTDVTLEFGFDSGAQPGESIIIDKIEFIPIEGSLEAYEADQALDKAWKAV

SEQ ID NO: 199 - DNA, 2124 bp, Bacillus thuringiensis
atgaatcaaaattatgagaactatggaaataatgaaatgaaaatattggattctggtatgagaaggtccagatatccgtatacgaatgcaccaagtgctgatttacaaaacatgaattataaagaatgggcggaaatgtgtggaaggaatgataacgttgctgtcccattgggatcagaaactagagcttcatctgaagctctatcgattgtcctaggtattacaggagatttgatcggtaatgcctttcctacagctggattgatgatcgggataatgggacatctttggccaaaacaagaggcagatatgcaagaggtctgggaaacccttatgaatgcggtggaagatctcattgatgcaaaaattgacgagttggtacgatcagaagcaatcgctgaattaagagccttacaaagtaatctcaatgtatataatgcggcgttagacgcttggctcacaacaggtgatgataataacagacaatgggtcattgctgaacatgacaattgtgatcaacaatttcgaaacgcattaaatcaattagcattaccaggttgggagttactattattaccatcttttgcagaagctaccaccctgtatcattttttctatcgagattttatgctgtactggcaagcctggggcatgtcccaagaggaatttaactttaaaaatagtgaacgaaaacgtctattccaagaaagtaccgactattgcgttagaatatataatgaaggtttaccggaatcaaaaacaccagacgtgaatatagaggatgctgtccgttatccatgggcaaatagagaccaaccagatcattgtaattcagaatatcgtgatgccgagggcgaatacctgtctactgaaacttggaatgcatacaatgcttaccggagaaatatgacagttatggtgttagaccttgtggcgatatggccactatatgatatagatctctatccaatagcgctagaagtgagaacggagcttacgcgagaagtgtatacagatatagcaggatcaacctggcgaacagattctagtcaaaatacgatagacgcaatagaaaatcgtatgttaggaaatcgattagggcctggcttatttacctggttaacagaactgaagttttatctaaagaatgtaactggtgattatagaacaaccggcaacctaatggtggggttagaaaaaacagtaaagaacacccgttctagtgagtataaaattccattagaaggacagaacacggattacacttctatcgtcaatcctaaagtggattattctccatattattgggcgatggttaatacacaacaatggtttgaaacccgatggcttcggatatcgaataatgtgggtagttatgctacaggcgaggtaggatcgataacagaatcttatccccctactgccagtacggggtgttttgataatgctgaaataaaagggatatataatgaaggttctcgatttactagtttaccttatcatcgattatcctggctcaaattcgatccagtagtggatgggaacaatgcatggcctcagtataaacaattaagcgctctcttatgtggttggacacacaccagtgtagattacaataacacgctatcgcttgataaaattaaccaaattccggcggtgaaagcatattctctagattacggtgctgttgttattaaagggcctggtagcacaggtggaaatttagtgcaattacctcctggtggaagggtaaagataaaattatggaaggaaactatagttcccaacttatataacttcagaattcgttatgcaactgctgcgaataatgctaacataacttttgggctagttcctgatgagtatgaaaacactcccataccatttgacctacccgctacgtattctggaggagaattgacatataatacctttaaatataaggctattgatacgttacagatttcgagcgagaacgtggaaatatttatcacgaatagtagtagtagtgcaggaactgttatcatcgacaaaatcgaattcgaaccacttcaagcaagtatacctttagaagaatatgtagcggaacaagatctagaaaaagcatggaaggctgtgaatgcc

SEQ ID NO: 200 - protein, 708 aa, Bacillus thuringiensis
MNQNYENYGNNEMKILDSGMRRSRYPYTNAPSADLQNMNYKEWAEMCGRNDNVAVPLGSETRASSEALSIVLGITGDLIGNAFPTAGLMIGIMGHLWPKQEADMQEVWETLMNAVEDLIDAKIDELVRSEAIAELRALQSNLNVYNAALDAWLTTGDDNNRQWVIAEHDNCDQQFRNALNQLALPGWELLLLPSFAEATTLYHFFYRDFMLYWQAWGMSQEEFNFKNSERKRLFQESTDYCVRIYNEGLPESKTPDVNIEDAVRYPWANRDQPDHCNSEYRDAEGEYLSTETWNAYNAYRRNMTVMVLDLVAIWPLYDIDLYPIALEVRTELTREVYTDIAGSTWRTDSSQNTIDAIENRMLGNRLGPGLFTWLTELKFYLKNVTGDYRTTGNLMVGLEKTVKNTRSSEYKIPLEGQNTDYTSIVNPKVDYSPYYWAMVNTQQWFETRWLRISNNVGSYATGEVGSITESYPPTASTGCFDNAEIKGIYNEGSRFTSLPYHRLSWLKFDPVVDGNNAWPQYKQLSALLCGWTHTSVDYNNTLSLDKINQIPAVKAYSLDYGAVVIKGPGSTGGNLVQLPPGGRVKIKLWKETIVPNLYNFRIRYATAANNANITFGLVPDEYENTPIPFDLPATYSGGELTYNTFKYKAIDTLQISSENVEIFITNSSSSAGTVIIDKIEFEPLQASIPLEEYVAEQDLEKAWKAVNA

SEQ ID NO: 201 - DNA, 1167 bp, Bacillus thuringiensis
atgaaaaaaacgttagtcgcagggttattagttacagcagtatctacaagttgcttcttacctgtaaatacttttgcagaaaataaaacaacttattcacaactaacaagtagtcaaaatcaacttgctatgaataggttatcagattcgattaagacattaggatcacagacaccattaattcaaggatacgggctaatcatagtaaagcaaccaaaccttgaagtaaatgctatacctggaataacaactgatcaaggtactgcaagaaaccatgttaaagaatggctggatacatataatccaaaactattcaatgtaaatcaagacctgcaggattttgggacaagatttacaaattattatgatatattggttgaactagctggaaaagtgaatgatgattcgcaaacaaaagaagactttgtaagtatttttaatgaacttcaagatcaaatgcaagcaattcagtatgatatgaaaggaacttcagtagacttaaacaattataaagaagacttggttgaagatagtaagagcttttctagtaaagttagcagagcgattgaactttataagggatcaggcggagacattgaaaaattcagaacggaaattaaacaacttgatgaaaacattcaagatgattatacaaaacttctagctctaccaaaagaaaatataaaaggttctataaatattggaaagacagttattgatatttcgatagacgcaggtaaggatcaaactttagacacgtctaatttggaagtgatttataaccaatttggacaagtccaaaatgatgaagtaacaagactgaataatgatgttcgtaagaagcaacaacaaaaaattctattgctacaaaaattatcgaacattgaagtgcaagcaactcaaatgacacttattgatctacagttaaataactttacaagagtagttaaaaagcaaattgagagttttgacaagctaataagtggttgggacatctttaataacacaatgattcaaataaataagagtcttagtactgatacgagaatagattctcatgcattacaagcacaattacaagaactcaaaaagtttacggatgaattgaataaacaaacagcggaatatgaaaatagtgttacaaacataaaagtaacagaggaaaaa

SEQ ID NO: 202 - protein, 389 aa, Bacillus thuringiensis
MKKTLVAGLLVTAVSTSCFLPVNTFAENKTTYSQLTSSQNQLAMNRLSDSIKTLGSQTPLIQGYGLIIVKQPNLEVNAIPGITTDQGTARNHVKEWLDTYNPKLFNVNQDLQDFGTRFTNYYDILVELAGKVNDDSQTKEDFVSIFNELQDQMQAIQYDMKGTSVDLNNYKEDLVEDSKSFSSKVSRAIELYKGSGGDIEKFRTEIKQLDENIQDDYTKLLALPKENIKGSINIGKTVIDISIDAGKDQTLDTSNLEVIYNQFGQVQNDEVTRLNNDVRKKQQQKILLLQKLSNIEVQATQMTLIDLQLNNFTRVVKKQIESFDKLISGWDIFNNTMIQINKSLSTDTRIDSHALQAQLQELKKFTDELNKQTAEYENSVTNIKVTEEK

SEQ ID NO: 203 - DNA, 2073 bp, Bacillus thuringiensis
atgagccaaaattacaacaacaatgaatatgaaatcatggacactggtggcaagggctatcagacaaggtaccccctggtgcaggcaccaggttctgaatttcagcaaatgaattataaagattggatgaatatatgtacaaatgaagagtcaggagaattatttgcagatttaaacactgctgtgaagaatggggtcattacaggaacagctattgtatcgtatatcctcagtgtatcatttcctgttgcttcagcagcagtcggtattcttagtgtactattgccaatattgtggccagaggaggctgaaaatcctcaatcgcagtttacgtgggatcagctgatgacggctgtagcagaactcattaataatgctattgctgcggaagcaaaaagggatgctattgatgcactccaaaaattacagatatccgtagatcgttatcagagagcagtctgtaatcttaaagttaacccagatatggacatttataaggccaatgtacgatcagcatttgtagaggttgatggagaagcacgcagagctattgccaccatggatgataatcctaccacacatgcagtccaattcttagctagttatgcagaagctgccaatgtacacttacttttattacgagatgttgtccaacacggagaaagttgggggtttacaccacttgaagttcaacaattttatgattatccttctggtggaccaggaacccgcggtatgaaacagctattggcacattatacggactattgtgtacgatggtataatatcggtttgcagcaacaatacgacactggtgagtgggataaattcaatgatttccgtagaaatatgaccatcatggtaatggatattgtgtcattatggccaacatatgatccaagactttatgcactgcctacaaaatcacaacttacaagaactgtgtatcaaggtcggattggatataattgggggctgacgcattctattgagaacatagaacagggggccactgttcctccacgtctatttgcatggttgcaaggaatagatgcctatgttggacaggttactgtagataatggaacaatacctgagaagattaatggttttacacaaacctttcagaacactttagcaaacttcttatggacaacaccactgatgggaccggctgttggcagaatccaaaccattacaattccgccggtagaatctaacgatgatgtctggagaattaaaagtggaacattttatgctgggcaccctttttggggatacgcccttaacgagatgcaattttctttaactaaatcagaagatcaacagatcggaactcagcttcctagtgaaagacaagaattgagcgggttatcttgtaatcctgttgctttcagtccttgtaatccttgtgattctaataactcttgtgaacatggaattcttgatacgagtgatccttgtaatgacaaactcctttatagtcatagattttcaaatctaggactcggagatgcaagttacaatggagtatatgcaggggttgtctacggctggacccatgtaagcgcagatgtaaacaatctgatagatgctgaaaagattacccaaattccagctgtgaaggcttccagaatggaggggaatgcacaagtaatcaaagggcctggtagcacaggaggtgatttgatagccataatcggccccttcgctgcttcgcgggtaacattgaacctgacgtttccactattcaatgaagaacgatactatcgtatgcgtgttcgttatgcctgtaaatcacagggcgatttagtaatttattcaaattggtttaatgatataaacattccatatgtaactcttcctttgaatgctacttattcttcggattcattaacatataattcttttgattatgtagaagtgaatgaggtgataccggtatacgcttgggcgactaacccaaacgctaagtttagcttggacacttcatcaagttcgacaatcatcatcgataaaatcgaattcataccaattgaaggatctttggaggagtatcaagcgagtcaagca

SEQ ID NO: 204 - protein, 691 aa, Bacillus thuringiensis
MSQNYNNNEYEIMDTGGKGYQTRYPLVQAPGSEFQQMNYKDWMNICTNEESGELFADLNTAVKNGVITGTAIVSYILSVSFPVASAAVGILSVLLPILWPEEAENPQSQFTWDQLMTAVAELINNAIAAEAKRDAIDALQKLQISVDRYQRAVCNLKVNPDMDIYKANVRSAFVEVDGEARRAIATMDDNPTTHAVQFLASYAEAANVHLLLLRDVVQHGESWGFTPLEVQQFYDYPSGGPGTRGMKQLLAHYTDYCVRWYNIGLQQQYDTGEWDKFNDFRRNMTIMVMDIVSLWPTYDPRLYALPTKSQLTRTVYQGRIGYNWGLTHSIENIEQGATVPPRLFAWLQGIDAYVGQVTVDNGTIPEKINGFTQTFQNTLANFLWTTPLMGPAVGRIQTITIPPVESNDDVWRIKSGTFYAGHPFWGYALNEMQFSLTKSEDQQIGTQLPSERQELSGLSCNPVAFSPCNPCDSNNSCEHGILDTSDPCNDKLLYSHRFSNLGLGDASYNGVYAGVVYGWTHVSADVNNLIDAEKITQIPAVKASRMEGNAQVIKGPGSTGGDLIAIIGPFAASRVTLNLTFPLFNEERYYRMRVRYACKSQGDLVIYSNWFNDINIPYVTLPLNATYSSDSLTYNSFDYVEVNEVIPVYAWATNPNAKFSLDTSSSSTIIIDKIEFIPIEGSLEEYQASQA

SEQ ID NO: 205 - DNA, 747 bp, Bacillus thuringiensis
atgattatacaagaaaaattatctttttcagatctagattcattagattcaactacagattccataatggacgcgtttaaagatctttatggaatactccctgatgagatcgcagtaaataatgagacatttcccattcgtaataagcctgctattactgaaagttatggtcacgcttgttataaaacgcttggaccctttatatttcgagaaattgaagagccttcaaagaataaagtaagcctaggagaacaatttgtatttaatcctagtaatgaagaagcagaaattgtagtctcaataaaggagcaatgggctaatattcaatcttggaattcagaatcaactacaggtttaactttaacatcagattttatcatgacaggtgaatttcgatctggaaataaatttaatatctcaacttttatgggagaaagtaattcaaaatcaatcattgcctctccttccattgagcgttctattaaagtacctccaaatagtaagataaaaataacaacaatcggaacattaattacagaaattctacattttcaatcaattatatcggtacacggtatgtttggtgcatgttttccacgaatggttcgtgggcattacgttggattcaaaagtgccggtcacatcctaaataaaacatttggttccataaaagggaccatttataatacagcaattcaggatattcaaataaaaactggagaggcagaacggttctggtgcacaaaa

SEQ ID NO: 206 - protein, 249 aa, Bacillus thuringiensis
MIIQEKLSFSDLDSLDSTTDSIMDAFKDLYGILPDEIAVNNETFPIRNKPAITESYGHACYKTLGPFIFREIEEPSKNKVSLGEQFVFNPSNEEAEIVVSIKEQWANIQSWNSESTTGLTLTSDFIMTGEFRSGNKFNISTFMGESNSKSIIASPSIERSIKVPPNSKIKITTIGTLITEILHFQSIISVHGMFGACFPRMVRGHYVGFKSAGHILNKTFGSIKGTIYNTAIQDIQIKTGEAERFWCTK

SEQ ID NO: 207 - DNA, 1944 bp, Bacillus thuringiensis
atggataacataaatcaaaatgattttgaaatactagatgcatcagcagaatatgcaaatcctccaatcattttagatgatacaagagatgcacaagaaacccttacaacggcactaacgataacaggggaaattcttagttttgcgggggtaccatttgtgggacccattattggttttactaatcgcttgatcaatttattatggccgcaaaagactacagatgtctgggaagaattcatgcagcgtgtagaggagctaataaacgagaaaattgcagaatatgcacgaagtaaagcattaacagaattacaaggactacaaaatgtctatcagttgtatcttgaggcactaagagaatgggaacaaaccccagataatccaagtgtacaagaacgagtaagaacgacatttcgtgatgcaaatgctgcctttaattatgcaatgcctcaatttgcagttagtggatatgaaattcccttattaacagtctatgcacaagcagcaaatctgcatatagttcttttaagagatgcagatttatttggaagtgggtggggttttacagaaacaaatgtcaacgaccgttacaatgaacaagtaagggtaacagatgcctattcaaatcattgcgtaaaatggtataataaagggttagagaagttaaaaaatcatcaaagtggtggagattggaagaaatataatcaatttcgtagagaaatgacattgatggtactagatattgtagcgttattcattaaccacgatacacgtaaatatcctatgaaaacagcggcacaacttacaagagatgtgtatacggaaccaattgcatatacgggaagcgggaatttttcagaaccttggtatactaaagtgggattttctacaattgagagtaaagtaatacgatcaccacatatttttgatatactagattcagtagaaatcagtacaggatttttagagtttctacaggcttcaggttatatgtatttttggtctggacatactttaactagctcacttgctaataataatacagtaaaaataacaaccacctatggtggtcttacaaatagtaaagaaaagtttagtataattggaaaagatttatataaaattaagtcggttgcattgggtctttctaatgtaaatatagatatgtatggagtgaaccccgtagatttctttatggtagataaaaacacttcaaatgtttcagaatatcactatagtaaagcaagtaatgtgttaagtgaaaataaagaaactatatattcagaaaaggaactacctccagaaacagaagatgaaccagattacaaagtattcagccatcggttatctcatatcactatgcttgttgtagagccgacaaccactcgtgcagcatatgtgtatttagcaggggttccaacctatgtttggacacacaagagtgcaacacctacgaatacaatatattcagatcagattacgcaaattccagcggtaaaaatgtatgaattaggaagctcagcggttgttgtaaagggacctggatttacaggcggagatgtagttaagagagcgggtaatggtgctctgggattttttaatattaatgtagagtccccaggtgctcagcggtatcgtttgagaattcgttatcgttcagatgttagtggcgtatttcatatgcaaattaacgacgtagaaactattcaggggaattttagtagtactgttgattcgccaagtactacgtcaagcgcatcatataatcatagagaatacagcaccaccttccgatttccaacgaatacgacaaagataaaggtatctttaggtgctattggtggtcaaggagacttttatttagatagaattgaattcattccagtagatgaaaattacgatgaaagagtaacactagaaaaagcacagaaagccgtgaatgcc

SEQ ID NO: 208 - protein, 648 aa, Bacillus thuringiensis
MDNINQNDFEILDASAEYANPPIILDDTRDAQETLTTALTITGEILSFAGVPFVGPIIGFTNRLINLLWPQKTTDVWEEFMQRVEELINEKIAEYARSKALTELQGLQNVYQLYLEALREWEQTPDNPSVQERVRTTFRDANAAFNYAMPQFAVSGYEIPLLTVYAQAANLHIVLLRDADLFGSGWGFTETNVNDRYNEQVRVTDAYSNHCVKWYNKGLEKLKNHQSGGDWKKYNQFRREMTLMVLDIVALFINHDTRKYPMKTAAQLTRDVYTEPIAYTGSGNFSEPWYTKVGFSTIESKVIRSPHIFDILDSVEISTGFLEFLQASGYMYFWSGHTLTSSLANNNTVKITTTYGGLTNSKEKFSIIGKDLYKIKSVALGLSNVNIDMYGVNPVDFFMVDKNTSNVSEYHYSKASNVLSENKETIYSEKELPPETEDEPDYKVFSHRLSHITMLVVEPTTTRAAYVYLAGVPTYVWTHKSATPTNTIYSDQITQIPAVKMYELGSSAVVVKGPGFTGGDVVKRAGNGALGFFNINVESPGAQRYRLRIRYRSDVSGVFHMQINDVETIQGNFSSTVDSPSTTSSASYNHREYSTTFRFPTNTTKIKVSLGAIGGQGDFYLDRIEFIPVDENYDERVTLEKAQKAVNA

SEQ ID NO: 209 - DNA, 2124 bp, Bacillus thuringiensis
atggagggaacaaagatgaatccatatcagaataaaaatgaatatgaaatagtagatggtccgcaaaattatgatactatttccaataggtatctttacgcgaataatcaggatattgtgatttccaacgaaatttccccctctattataggaggacttagcactttattaagcctttttttggattacaaatctttacttggaagtccttctatatcagggggaatcggttttctacaatctattataggtataataactgatactaacgtagcaactgttactatagatgatgtgcaacgattgattaatcaatcgctagatacgtatacgagacaacaggcagagactaaaatggaatccataacgagtgattatactcaatatcttctaaatttacgcgattatatagatggacgagcaagtcgaagtgattttgtacaaagtcttcgaaataatgaacagagactaagaaatgaattggattctttttttagtttgcaggggcgagaattgttgttattaccgaactttgtgcaagtttcgttattacatttagcaatattaagggatgctgtggtttatggaggaactgatttagaaagaccacttgtcagtgaaacagctcaaataccttttttaactcgacctcctagtagttcttatcatgaagcaattttaactagcctacgtgtatattccaattattgtacgcaacaatacaatataggtttaaacaatatgagaaatagaggtacttcaggtagagattggttaaactttcatgcatatcggagagacctaactttatccgtgttagattttgtggcaattttcccatttttcgatccattacaatatattacaacgagaaatgtatcgctaccagtaaattctcaattaagtagggttatatatacagatcctgcaggtattatatctatcaatggacaaaccggctggtttaatcctggtgctactcagagtgttgttaggcctacttttgcatcaatagaaaatgacatgccggctcctacaacttcgcgatttttagagaatatagaaattttttcaggtccacttggtgtaggtgtaaatccaagtagaacacatgcgtggcagggaaatgaaaatcgaaattcaaataatacagtagatctttttggaatgagaactaatcaaaggacaaatctttctggtcaaaatattttcagggtggtttcaaatgttcatactctggattctcggttgtttggagtttatggagcggattttcttcatgccaatggtcaaatatctcgatatcaagcaccacaaagccctccatcagctatcggtgttgcacgacagactcattttcaatttttgccaggaacaacatccaatataccaaatacaaataattatactcatttattaagtagggtagcaaatataactggaggacttcagccaacaatagcggaacaacgtaattctgtggtaatacatggttggacacatagaagtttaactcgtgaaaatattattgcacctgatagcattacgcaaatccctgcagtgaaaacaagtttttctccgaattgtactgtaattccaggaccaggttttactggaggtgatttagtaagattagatgctaatggcagatttgatatacaagttcaattaccaacaacacaaagaagttatcgaattcgcttacgctatgcttctgcatcgacaggttcaataaatattgtctttagtggcactagtcatccaagtacactaccttctacgacttcatcactcaacaatctacaatatgagaattttcgttattttgatgttattggtacttttttatcttcattgggtaatgggttaagtatttcgaatttaactatgaattctaatgttgtaatagacaaaattgaattcattccagttggtacttttacaaatcaatcatttagagaaacacaagggtataacaataattacaatcagaatactagtagtacatatgacaatacgtcctaccaaaataacaatgatatatataaccaagactatcacaatacttacaaccaggactgtagatgtaattgtaatcaaggttataataataactatcccaag

SEQ ID NO: 210 - protein, 708 aa, Bacillus thuringiensis
MEGTKMNPYQNKNEYEIVDGPQNYDTISNRYLYANNQDIVISNEISPSIIGGLSTLLSLFLDYKSLLGSPSISGGIGFLQSIIGIITDTNVATVTIDDVQRLINQSLDTYTRQQAETKMESITSDYTQYLLNLRDYIDGRASRSDFVQSLRNNEQRLRNELDSFFSLQGRELLLLPNFVQVSLLHLAILRDAVVYGGTDLERPLVSETAQIPFLTRPPSSSYHEAILTSLRVYSNYCTQQYNIGLNNMRNRGTSGRDWLNFHAYRRDLTLSVLDFVAIFPFFDPLQYITTRNVSLPVNSQLSRVIYTDPAGIISINGQTGWFNPGATQSVVRPTFASIENDMPAPTTSRFLENIEIFSGPLGVGVNPSRTHAWQGNENRNSNNTVDLFGMRTNQRTNLSGQNIFRVVSNVHTLDSRLFGVYGADFLHANGQISRYQAPQSPPSAIGVARQTHFQFLPGTTSNIPNTNNYTHLLSRVANITGGLQPTIAEQRNSVVIHGWTHRSLTRENIIAPDSITQIPAVKTSFSPNCTVIPGPGFTGGDLVRLDANGRFDIQVQLPTTQRSYRIRLRYASASTGSINIVFSGTSHPSTLPSTTSSLNNLQYENFRYFDVIGTFLSSLGNGLSISNLTMNSNVVIDKIEFIPVGTFTNQSFRETQGYNNNYNQNTSSTYDNTSYQNNNDIYNQDYHNTYNQDCRCNCNQGYNNNYPK

SEQ ID NO: 211 - DNA, 2013 bp, Bacillus thuringiensis
atgagtccaaataatcaaaatgaatatgaaattatagatgcgacaccttctacttctgtatccaatgattctaacagatacccttttgcgaatgagccaacaaatgcgctacaaaatatggattataaagattatttaaaaatgtctgcgggaaatgctagtgaataccctggttcacctgaagtacttgttagcggacaagatgcagctaaggccgcaattgatatagtaggtaaattactatcaggtttaggggtcccatttgttgggccgatagtgagtctttatactcaacttattgatattctgtggccttcaggggaaaagagtcaatgggaaatttttatggaacaagtagaagaactcattaatcaaaaaatagcagaatatgcaaggaataaagcgctttcggaattagaaggattaggtaataattaccaattatatctaactgcgcttgaagaatgggaagaaaatccaaatggttcaagagccttacgagatgtgcgaaatcgatttgaaatcctggatagtttatttacgcaatatatgccatcttttagagtgacaaattttgaagtaccattccttactgtatatgcaatggcagccaaccttcatttactgttattaaaggacgcgtcaatttttggagaagaatggggatggtcaacaactactattaataactattatgatcgtcaaatgaaacttactgcagaatattctgatcactgtgtaaagtggtatgaaactggtttagcaaaattaaaaggcacgagcgctaaacaatgggttgactataaccaattccgtagagaaatgacactggcggttttagatgttgttgcattattcccaaattatgacacacgcacgtacccaatggaaacgaaagcacaactaacaagggaagtatatacagatccactgggcgcggtaaacgtgtcttcaattggttcctggtatgacaaagcaccttctttcggagtgatagaatcatccgttattcgaccaccccatgtatttgattatataacgggactcacagtgtatacacaatcaagaagcatttcttccgctcgctatataagacattgggctggtcatcaaataagctaccatcgtgtcagtaggggtagtaatcttcaacaaatgtatggaactaatcaaaatctacacagcactagtacctttgattttacgaattatgatatttacaagactctatcaaaggatgcagtactccttgatattgtttaccctggttatacgtatatattttttggaatgccagaagtcgagtttttcatggtaaaccaattgaataataccagaaagacgttaaagtataatccagtttccaaagatattatagcgagtacaagagattcggaattagaattacctccagaaacttcagatcaaccaaattatgagtcatatagccatagattatgtcatatcacaagtattcccgcgacgggtaacactaccggattagtacctgtattttcttggacacatcgaagtgcagaatttaataatataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattccagttactgcaacactcgaagctgaatataatctggaa

SEQ ID NO: 212 - protein, 671 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLE

SEQ ID NO: 213 - DNA, 2010 bp, Bacillus thuringiensis
atgaaccaaaataatcaaaatgaatatgaagttattgatgctccccattgtgggtgtccgtcagatgatgatgttaggtatcccttggcaagtgacccgaatgcagcgttacaaaatatgaactataaagagtatttacaaacgtatggtggagactatacagattctcttatcaatcctaatttatctattaatcctagagatgtgctggaaattggaattacggttgtgggaagaatattaggatttataggttttcccttctctggagcaataacaagtttttatacgtttctcttaaatcaactgtggccaactaataataatgcagtatgggaagcatttatggcgcaaatagaagagctgatcgatcaaagaatatcggctcaagtactaagggatgcacttaatgccttaactggaatacacgattattataacgaatatttagcggcattggaagagtggctggaaagaccgagcggcgcaagagctaacttagttacacagaggtttgaaaatctgcatcaatcctttgtaactcagatgcctagctttggtagtggtcctggtagccaaagagatgcggtagcattgttgacggtatatgcacaagcagcgaatctccatttgttattattaaaagatgcagaaatttatggggcaagatggggacttcaacaaggtcagattaacttatatttcaatgcgcaacaagagcgtactcaagtttataccaatcattgtgtggaaacatataatagaggattagaagatgtaagaggaacaaatactgaaagctggttaaattaccatcgtttccgtagagagatgacattaatggcaatggatttagtcgcattattcccatattataacgtacgacgatatgcaaatggggcaaatccacagcttacacgtgagatatatacagatccgattatatttaatcccccggctaatgtaggattatgtagacgttggggcaataacccatataatacattttcggaacttgaaaatgcttttattcgtccaccacatctttttgatagattaaatagcttatcaattaatcggtctcgatatccaatttctaataattttattgaatattggtcaggacatgttgtacgccgtagtttttcgaatgactcgactgtatatgaaaatagttacggtgcaacaaataatttaacaactatactcaatatgggggctactggagttagccgaattgattcaacagcagtagattttcgtagcactatagctggggtatatgtcgtttctagagctcgttttggaaatgtaggttcgtttattaatgtgtcacagccggttaatgggggatgcaggcaagagtatgacacaatagatgaattaccacaagatgaaagtaatgggatgttcgaccataaattatctcatgtgacctttttaagttttcagactacgcaggcgggaacccttgctcatggaggtttcgttcctacgtatgtttggacccatcgcgatgtagattttaataacacaattacttcaaatagaactactcaactaccattagtaaagtcatttcaaatagatgggggtactactgtcgtaagaggaccaggatttacaggaggagatgtacttcgaagaacaagtcctggtgcattaggaacaattagagtaaatgttaattcaccattaacacaaagatatcgtgttagatttcggtatgcatcaacaacagattttaatttctttgtaatacgtggaggtactactgtaaataattttacattcccaagaacaatgaacagcggacaggaatcgagatacgaatcctatgtcacaagagagttttctacgccttttaatttcttacaggtacaagatacacttagattggcggtgcaatcgtttagctctgggcaacaagtgtatgtcgatagaattgaaatcatccctgtgaatccgacaagagaagcggaagaggatttagaagcggcgaagaaagcg

SEQ ID NO: 214 - protein, 670 aa, Bacillus thuringiensis
MNQNNQNEYEVIDAPHCGCPSDDDVRYPLASDPNAALQNMNYKEYLQTYGGDYTDSLINPNLSINPRDVLEIGITVVGRILGFIGFPFSGAITSFYTFLLNQLWPTNNNAVWEAFMAQIEELIDQRISAQVLRDALNALTGIHDYYNEYLAALEEWLERPSGARANLVTQRFENLHQSFVTQMPSFGSGPGSQRDAVALLTVYAQAANLHLLLLKDAEIYGARWGLQQGQINLYFNAQQERTQVYTNHCVETYNRGLEDVRGTNTESWLNYHRFRREMTLMAMDLVALFPYYNVRRYANGANPQLTREIYTDPIIFNPPANVGLCRRWGNNPYNTFSELENAFIRPPHLFDRLNSLSINRSRYPISNNFIEYWSGHVVRRSFSNDSTVYENSYGATNNLTTILNMGATGVSRIDSTAVDFRSTIAGVYVVSRARFGNVGSFINVSQPVNGGCRQEYDTIDELPQDESNGMFDHKLSHVTFLSFQTTQAGTLAHGGFVPTYVWTHRDVDFNNTITSNRTTQLPLVKSFQIDGGTTVVRGPGFTGGDVLRRTSPGALGTIRVNVNSPLTQRYRVRFRYASTTDFNFFVIRGGTTVNNFTFPRTMNSGQESRYESYVTREFSTPFNFLQVQDTLRLAVQSFSSGQQVYVDRIEIIPVNPTREAEEDLEAAKKA

SEQ ID NO: 215 - DNA, 2217 bp, Bacillus thuringiensis
atggaggaaaataatcagaatcaatgcgtcccttataattgtttgaataatcctgcaatcgaaatattagaaggagacagaatatcagttggtaacactccaatcgatatttctctatcacttgtggaacttcttattagtgaatttgtcccaggcggtggaataataacaggattgttgaacatagtatggggatttgtagggccttcccaatgggacgcatttcttgctcaagtggaacagttaattaaccaaaggatatcagaagctgtaagaaatacagcaattcaggaattagagggaatggcgcgggtttatagaacctatgctactgcttttgctgagtgggaaagagatcctaataacacagatctaagagaagtagtacggacacagtttacagcaactgagacttatatcagtggaagaatatctgttttaaaaattcaaaattttgaagtgcagctgttatcggtgtttgcccaagctgccaatttacatttatctttattaagagacgttgtgttttttgggcaaagatgggggttttcaacgacaaccgtaaataattactacaatgatttaacagaagagattagtacctatacagattatgcagtacgctggtacaatacgggattagagcgtgtatggggaccggattctagagattgggtaaggtataatcaatttagaagagagctaacacttactgtattagatatcgttgctctattcccaaattatgatagtcgaaggtatccaattcgaacagtttcccaattaacaagagaaatttatacgaacccagtattagaaaattttgatggtagttttcgaggaatggctcagagaatagaacagaatattaggcaaccacatcttatggatatccttaatagtataaccatttatactgatgtgcatagaggctttaattattggtcagggcatcaaataacagcttctcctgtaggattttcaggaccagaattctcattccctttatttgggaatatgggaaatgcagctccacccatacttgtctcattaactggtttggggatttttagaacattatcttcacctttatatagaagaattatacttggttcaggcccaaataatcaggaactgtttgtccttgatggaacggagttttcttttgcctccctaacgaccaacttgccttccactatatatagacaaaggggtacagtcgattcactagatgtaataccgccacaggataatagtgtaccacctcgtgcgggatttagccatcgattgagtcatgttacaatgctgagccaagcagctggagcagtttacaccttgagagctccaacgttttcttggcagcatcgcagtgctacgacaactaatataattgcagcggatagtattactcaaattcctgctgttaaaggacgttctattattaataatggcacggtaatttcaggaccagggtttaccggaggcgatttggttagattatacaatgctgattttaatattaataatagagcataccttgaagttccgatattcttccaatcaccctctacaaattatcgtgttcgtgttcgttatgcttctacatcttcactccctgtagatgtagttttcggaaatattagtcatcctactacattcccagccactgccagatcattagataatctacaatccaatgattttggatatattgatattgctggaactttcttaccttcactagggcctagtataggtatcagacctatgttatctactattaatttgatagtagatagatttgaatttattccagtaactgcaacctttgaagcagaatcggatttagaaagagcacaaaaggcggtgaatgcgctgtttacttctacaaaccaactagggataaaaacagatgtgacggattatcatattgatcaagtgtccaatctagttgagtgtttatcggatgaattttgtctggatgaaaagcaagaattatccgagaaagtcaaacatgcgaagcgactcagtgatgagcgaaatttacttcaagatccaaacttcaggggcatcaatagacaaccagatcgtggctggagaggaagtacggatattaccatccaaggaggagatgacgtattcaaagagaattacgtcacactaccaggtacctttgatgagtgctatccaacgtatttatatcaaaaaatagatgag

SEQ ID NO: 216 - protein, 739 aa, Bacillus thuringiensis
MEENNQNQCVPYNCLNNPAIEILEGDRISVGNTPIDISLSLVELLISEFVPGGGIITGLLNIVWGFVGPSQWDAFLAQVEQLINQRISEAVRNTAIQELEGMARVYRTYATAFAEWERDPNNTDLREVVRTQFTATETYISGRISVLKIQNFEVQLLSVFAQAANLHLSLLRDVVFFGQRWGFSTTTVNNYYNDLTEEISTYTDYAVRWYNTGLERVWGPDSRDWVRYNQFRRELTLTVLDIVALFPNYDSRRYPIRTVSQLTREIYTNPVLENFDGSFRGMAQRIEQNIRQPHLMDILNSITIYTDVHRGFNYWSGHQITASPVGFSGPEFSFPLFGNMGNAAPPILVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSATTTNIIAADSITQIPAVKGRSIINNGTVISGPGFTGGDLVRLYNADFNINNRAYLEVPIFFQSPSTNYRVRVRYASTSSLPVDVVFGNISHPTTFPATARSLDNLQSNDFGYIDIAGTFLPSLGPSIGIRPMLSTINLIVDRFEFIPVTATFEAESDLERAQKAVNALFTSTNQLGIKTDVTDYHIDQVSNLVECLSDEFCLDEKQELSEKVKHAKRLSDERNLLQDPNFRGINRQPDRGWRGSTDITIQGGDDVFKENYVTLPGTFDECYPTYLYQKIDE

SEQ ID NO: 217 - DNA, 1884 bp, Bacillus thuringiensis
atggagaataatattcaaaatcaatgcgtaccttacaattgtttaagtaatcctgaggagatacttttagatggagaaagaatatctactggtaattcatcaattgatatttctctgtcacttgttcagcttctggtatcaaactttgtaccagggggaggatttttagttggattactagattttgtatggggaatagtaggcccttctccatgggatgcatttttagtgcaaattgaacaattaattaatgaaagaatagctgcatatgctagggatgctgctattgctaatttagaaggtttaggaaacaatttcaatatatatgtggaagcatttaaagaatgggaaggaaatcctaatgattcagcagcaaggaccagagtaattgatcgctttcgtatacttgatgggctacttgaaagggatattccttcgtttcgaatttctggatttgaagtaccccttttatccgtttatgctcaagcggccaatctgcatctagctatattaagagattctataatttttggagaaatatggggattgacaacgacaaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcaaacagttggtcaactatcaagggaagtttatacggacccattaattaattttaatccccagttacagtctgtagctcaattacctacttttaacgttatggagagcagcgcaattagaaatcctcatttatttgatatattaaataatcttacaatctttacggattggtttagtgttggacgcaacttttattggggaggacatcgagtaatatctaaccgtataggaggaggtaacataacatctcctatatatggaagagaggcgaaccaggaacctccaagatcctttacttttaatggaccggtatttaggactttatcaaatcctactttacgattattacagcaaccttggccggcgccaccatttaatttacgtggtgttgaaggagtagaattttctacacctacaaatagctttacgtatcgaggaagaggtacggttgattctttaactgaattaccgcctgaggataatagtgtgccacctcgcgaaggatatagccatcgtttatgtcatgcaacttttgtccaaagatctggaacaccttttttaacaactggtgtagtattttcttggacgcatcgtagtgctactgatcgaaatataatctacccggatgtaattactcaaattcctgctgttaaaggtaactttctttttaatgcagctgtaaacccagggccaggatttactgggggagatacagttagattaaacaatagtggaaataatattcaaaatagaggctaccttgagattccaattcaattcacatcgacagctatcagatatcgagttcgtgtacgttatgcttctgtaaccccaattctcctcagtgttaattttgggaatacaaacattttttctaacacagtaccagctacagctgcgtcattagataacctaaaatcaggggattttggttatttagaaagcaccagtgcttttacatctgtagcaagtaatgtagtaggtattagaaattttagtgagaatgcaggagtgataatagacagatttgaatttattccagttactgcaacatttgaggcagaatatgatttagaaagagcgcaaaaggcggtgaatgccctgtttacgtctaca

SEQ ID NO: 218 - protein, 628 aa, Bacillus thuringiensis
MENNIQNQCVPYNCLSNPEEILLDGERISTGNSSIDISLSLVQLLVSNFVPGGGFLVGLLDFVWGIVGPSPWDAFLVQIEQLINERIAAYARDAAIANLEGLGNNFNIYVEAFKEWEGNPNDSAARTRVIDRFRILDGLLERDIPSFRISGFEVPLLSVYAQAANLHLAILRDSIIFGEIWGLTTTNVNENYNRLIRHIDEYADHCANTYNRGLNNLPKSTYQDWITYNRLRRDLTLTVLDIAAFFPNYDNRRYPIQTVGQLSREVYTDPLINFNPQLQSVAQLPTFNVMESSAIRNPHLFDILNNLTIFTDWFSVGRNFYWGGHRVISNRIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATDRNIIYPDVITQIPAVKGNFLFNAAVNPGPGFTGGDTVRLNNSGNNIQNRGYLEIPIQFTSTAIRYRVRVRYASVTPILLSVNFGNTNIFSNTVPATAASLDNLKSGDFGYLESTSAFTSVASNVVGIRNFSENAGVIIDRFEFIPVTATFEAEYDLERAQKAVNALFTST

SEQ ID NO: 219 - DNA, 978 bp, Bacillus thuringiensis
atgaagaagaaaaataataaaaagacaaaacaaattctttctcttgctatgcttggagctattggaacatcattagcatttacatctccaggttcagtaagtgctgctgaaattagttctattcaaagtgctgcgcaagaacaaggaagtgtatctatatcagattggcgtgagcctttcagaaatgcatacaagattgctaacaagaatgatccttacacttattttggcgaggatgcaacagagtatacactcggtaatgtttaccaatcgtcggtggaagcggatggttcccctactattactaattcacgtagtttatttgtagggagagcaattttaaagaatgatttagatgaagagcaaacgcttactacagatcaattttcaaagacattcgaaaattctgtcactaattccactacaaatggatttaacttaggggtaagtgcctcttcatcatttggtattccacttattggagagacaagtgttgaaatatctactgaatataatttttcaagtacagaggaaaaaacgaagagtgaaagttatacttataccgctagtccacaaaacatcaaagttcctgcacattcatctgtagaagttattgtaaatttaaatacggctaaaataagcggtaaagtaaaacttctttctaaaattgatggtacatttactcatgcttctggaggagatggtagcttcactgctacgagaggtctttgggcattagagtacgatgcttctatgtatgagaaacttagtgatttaaaatctgctagagtaggagcagaagcatatgggccggtatatttgataggaagtggtaaatattcagctgaatatggaacagagtttgctgtaactgtaaggccagttgaaaaacctaacggatttaaatctatgattgctgaaaatagcaaatcaactaatgaaggttatacttataaggtaaaaccagaaattaaaaaa

SEQ ID NO: 220 - protein, 326 aa, Bacillus thuringiensis
MKKKNNKKTKQILSLAMLGAIGTSLAFTSPGSVSAAEISSIQSAAQEQGSVSISDWREPFRNAYKIANKNDPYTYFGEDATEYTLGNVYQSSVEADGSPTITNSRSLFVGRAILKNDLDEEQTLTTDQFSKTFENSVTNSTTNGFNLGVSASSSFGIPLIGETSVEISTEYNFSSTEEKTKSESYTYTASPQNIKVPAHSSVEVIVNLNTAKISGKVKLLSKIDGTFTHASGGDGSFTATRGLWALEYDASMYEKLSDLKSARVGAEAYGPVYLIGSGKYSAEYGTEFAVTVRPVEKPNGFKSMIAENSKSTNEGYTYKVKPEIKK

SEQ ID NO: 221 - DNA, 2139 bp, Bacillus thuringiensis
atgtttagagtcctttatatcaaaaattttgagcatacggagggaataaaaatgaatacttatcaatataaaaatgaatatgaaatattggatgctttaccaaattattcgaacacggtaaatacttattcaaggtatccgttagcaaataattcacaagctcctttacaaaacacaaattataaagattggcttaatatgtgtccaaataataatatattgtgtactcctagagatattgatattaattctgtctctgccactataggggcagtaggtactatattatctcttattcctggtccaggagaagcaataggatttgttttagcaactttcacatcactaataccttatctttggccaagtgacacaaaaacaatatggggagatttcacaaaacaaggattgcaactttttagaccggagctaggcagagatgcaatagaaattataggcaacaacgtacaatcaggatacaatacgttaaaagacatgatgcagaactttgagactaggtttgcaacttggaaaatccatagaactagagctaatgcaacattggtcatatctgcatttgacaatgttagtgatcaaattctccgacttaaaaatgacttcttaataaatcccgaaaataaacccgcatttctaaatctctatgcacaaactgccaattttgatttaattttatatcaaagaggggccgtatatggagatgattgggtaaaagatataaataatagatccatattttcttctggttcagcagcctattatgaatgtttgaaactgaaaatagtagagtatactaacaattgtgcagaaacatatagaaacagtttaaatatactcaaaaacaagtctaatatctcatgggatacgtataataaataccgtagagaggtgactttaggtgcattagatttagttgcgttattcccaaattacgatatatgtatttatccaatacaaacaaaaacagaacttactagaaaaatttatatgccatcattctatttacaagcacttggacaaagcggaaatctagaatcattggaaaaccaacttacacatcccccatcattatttacttggttaaacgaattaaacctttatacaataagtgaaaatttcaatccggctttaagggtatcttcattgtcaggtcttcaagctaaatatcgttatacccaaaatccggctatacttcctaatccggctcaaggaatcacaaatggcacaccgataccaatagggctaaataacttgtttatttataaattatcaatgtcacaatatcatgatccaaatgattgttatccaatagctggaatttccgatatgaccttttataaaagtgactataatggtaatgcgtccacaactcaaacttatcgagcaggtagaaactcaaataatgtcatagatacatttatgaatggcccacaaaatgcatcaagctcaaataatatttccattaaacaaacaaaccatatactatctgatattaaaatgaactactctcgaattggcggaatatacccatcatatacttttggatattcatttgcttggacacatactagtgtagatcctgacaatctgattgttccaaacagaattacacaaattcctgctgttaaagctgattctctgacttcaccagctagagtaattgcaggccctggtcatacaggaggcgatttagttgctcttctaaacgatggcactcaagctggcagaatgcaaatccgatgtaaaacaggtaactttactggagcttccagacgttatggtttacgcatgcgttacgctgcaaataatgaatttacagtgaatctatcatatagcttacagggtggtaatccatccggtacatcatttgttacagaacgtacattttcaagaactaataatataataccaacagatttaaattacagggagcttaaatataaagaatattatcaaattattacaatgactttacctgcaaatacagtaataactatatctattcaacaagcaaatgggtttttaaataatcaattgattattgacagaattgaattttatccaacggatcaaggtatagtagcttgcgaactggatcaaaatgcaataagttgtaaaatt

SEQ ID NO: 222 - protein, 713 aa, Bacillus thuringiensis
MFRVLYIKNFEHTEGIKMNTYQYKNEYEILDALPNYSNTVNTYSRYPLANNSQAPLQNTNYKDWLNMCPNNNILCTPRDIDINSVSATIGAVGTILSLIPGPGEAIGFVLATFTSLIPYLWPSDTKTIWGDFTKQGLQLFRPELGRDAIEIIGNNVQSGYNTLKDMMQNFETRFATWKIHRTRANATLVISAFDNVSDQILRLKNDFLINPENKPAFLNLYAQTANFDLILYQRGAVYGDDWVKDINNRSIFSSGSAAYYECLKLKIVEYTNNCAETYRNSLNILKNKSNISWDTYNKYRREVTLGALDLVALFPNYDICIYPIQTKTELTRKIYMPSFYLQALGQSGNLESLENQLTHPPSLFTWLNELNLYTISENFNPALRVSSLSGLQAKYRYTQNPAILPNPAQGITNGTPIPIGLNNLFIYKLSMSQYHDPNDCYPIAGISDMTFYKSDYNGNASTTQTYRAGRNSNNVIDTFMNGPQNASSSNNISIKQTNHILSDIKMNYSRIGGIYPSYTFGYSFAWTHTSVDPDNLIVPNRITQIPAVKADSLTSPARVIAGPGHTGGDLVALLNDGTQAGRMQIRCKTGNFTGASRRYGLRMRYAANNEFTVNLSYSLQGGNPSGTSFVTERTFSRTNNIIPTDLNYRELKYKEYYQIITMTLPANTVITISIQQANGFLNNQLIIDRIEFYPTDQGIVACELDQNAISCKI

SEQ ID NO: 223 - DNA, 981 bp, Bacillus thuringiensis
atgaaaaatagtaaaaaattaaaaagaaaaatattagcttgtggagcaatcgcatctattgggaccacacttgtatcgtcatcaccaattttagctagtgcagagcaaattaatacttcagaattagaaagagatcaaaaggctgaagctatattagaatggaaagaaccacttttcaaggctacggaagtttatggaaaaaacatagttgttccaagtggatatgaatatcgttccacttggtcggacgggtatcatacttcctataaaaatttagaatatcaccaattttcagtagcagcagatggtctgcctaacattactaatttaaacactgtatttgttggaaagaccaccctaactaataatacaaaccaagaacaaacgttatctactaatagtttttcgaaagcgattacaaattcagttactcattcaactacacatggttttaaatttggaaccaaagcatcttcgaaatttaaaattcctattgtaggagaaacaacagttgaattatctgcagaatacaatttttcagatacatctagtcaaacaagctctgaaagttacacttatatttctacaccacagaatataaaagttcctgcccattcatctgtagaagtttttgtaactttaaatacagttaaagcaaaagggaatgtaaaacttcttgctaaaatgtctggtgaggatagaggtagctttatttataactctacaacaggaggtcctggtaaagagtatgtttataataaaacatttaattcaatagtttcatatgcttcgaaaattgaaaaacttcaaaatatctcagctaatccagatggcaaaacagtaaatattataggttcaggtatttatgaagctgaatatggaactgagtttgatgtaactgtaacacctattgataaaaatggaaagtcggtagataagggttatacgtataaggtgaaaccggagattacaaaagaaaaa

SEQ ID NO: 224 - protein, 327 aa, Bacillus thuringiensis
MKNSKKLKRKILACGAIASIGTTLVSSSPILASAEQINTSELERDQKAEAILEWKEPLFKATEVYGKNIVVPSGYEYRSTWSDGYHTSYKNLEYHQFSVAADGLPNITNLNTVFVGKTTLTNNTNQEQTLSTNSFSKAITNSVTHSTTHGFKFGTKASSKFKIPIVGETTVELSAEYNFSDTSSQTSSESYTYISTPQNIKVPAHSSVEVFVTLNTVKAKGNVKLLAKMSGEDRGSFIYNSTTGGPGKEYVYNKTFNSIVSYASKIEKLQNISANPDGKTVNIIGSGIYEAEYGTEFDVTVTPIDKNGKSVDKGYTYKVKPEITKEK

SEQ ID NO: 225 - DNA, 2202 bp, Bacillus thuringiensis
atgaatcagaattacaataacaatgaatatgaaatcaaagatgttggcgtcatggactatcagccaaggtatcctcttgcgcaggcacctagtgccgaattgcaacaaatgagttataaggattggatggataggtgtgaacgaggatcgctggcaatcacatttaaatccgttattacaaccgctttagatattacgtctgcaatcctcggtgcggcaaaatctccaaaagctaaagtagcaagagctgcggttcaagtccttaatagcgttattaaattgctgtggcctgaaccagaaaaaccttctgaaccagcatacgatatagatttcatatggaaagaactgataaagagagtcgagatactgattgaagaaaaaattgatcgagaagcatataacgccgcaattggaagattatcaggattaaagagagctttaaatttatatcaaatagcgttttgggattggctcaaagatgaaaatgaccctgagttacaggcagagttacgaactcggtttacggctgcactgtttgaacttgtgactacaattgaaacatttaaatacaatggacaagagttaaatttgctgacaatttttgtacaagctgcagattttcacttaatgttattacaacaagggataatgtatggagttcggtggggattcgatcagaggacggtagattctctttatcaaaatgacagtggagaaggtttgaaaaatttgctaccgaagtattctgattatgccacctattggtatggccaaggtttgaatagagcaaaaaacttgaaggcaaatttatcagatacagtaagatatccttgggccgcaaacttagaagatacgagtgtattacaagagctagaggattggaacctatataacgattatcgaagagacatgacaatcttagtattagacttggttgctgtatggccaacatatgacctccattattacgataatggaaactatggggtacagtctgaactcacacgatctatatactctcaagcagtaggaaatgtaatgggaactgtatttacaaaagagcaatacgaggttagcttcgttcgcccaccacacttagttacatggttagaaaaaatgtttgttcatataagagacaaggaacagggcgcacctaacgatgcagaaatggctggtataagtctagattattcttattcaggttgggataatacggtttatgacatacttcaaggatatccagcgactgggggtagtcaaattcgtgtgcttgcaaaaagtaacgtgatcgttcaagatcaagagaaaaatcgagcgatttacaatacagatctccaacatgataaattagtagatcgatttgttttttatcaaaatagtggagaagttaactatgctggtagagataatccgtcaagctataaaacatttgcatgggatactgatgttaccaactatagtagtcaaatgacatggataaatggaccagtaaatgaaggccattttggttatattcaggcttatgcgccggaatggattcctgcaagttgtgaaccgtttaatactatcgtggatgcagaagatgtaattactcaaataccggcagtgaaagctcgagaattaaaatatggtgcacgtgttataaagggtctgggctatacaggtggagatctagtgtctattgcacccaatggtttgtgtgagttgtacgtgtcatttccaaatgtagcccgaagatatcaggttcgagtacattatgcatgtcaggattcgaccaaaataaaactacgtataggggattcaagtcatgatattaaacttcaatctacgtattctggaggggcattaacatacgattcatttggttatgcaacaagtgaatacagttatctattttatcctgatttttatgatgagaaacagatagtacgtttgggaaatgattttgatataacacagcaagatatcatcattgataagattgaatttattcctgttgatatcttctatgcagaggaacaagcattaaaacaagcaagaaaggccgtgaatgccttgtttacaggtgctgcaaaagatgtcctgaaattgaatgtgacggattatgcagtcgatcaagctgccaatcttgtcgaatgtgtatcggatgaattccatgctcaagaaaaaatgatcctactggatcaagtgaaattcgccaaa

SEQ ID NO: 226 - protein, 734 aa, Bacillus thuringiensis
MNQNYNNNEYEIKDVGVMDYQPRYPLAQAPSAELQQMSYKDWMDRCERGSLAITFKSVITTALDITSAILGAAKSPKAKVARAAVQVLNSVIKLLWPEPEKPSEPAYDIDFIWKELIKRVEILIEEKIDREAYNAAIGRLSGLKRALNLYQIAFWDWLKDENDPELQAELRTRFTAALFELVTTIETFKYNGQELNLLTIFVQAADFHLMLLQQGIMYGVRWGFDQRTVDSLYQNDSGEGLKNLLPKYSDYATYWYGQGLNRAKNLKANLSDTVRYPWAANLEDTSVLQELEDWNLYNDYRRDMTILVLDLVAVWPTYDLHYYDNGNYGVQSELTRSIYSQAVGNVMGTVFTKEQYEVSFVRPPHLVTWLEKMFVHIRDKEQGAPNDAEMAGISLDYSYSGWDNTVYDILQGYPATGGSQIRVLAKSNVIVQDQEKNRAIYNTDLQHDKLVDRFVFYQNSGEVNYAGRDNPSSYKTFAWDTDVTNYSSQMTWINGPVNEGHFGYIQAYAPEWIPASCEPFNTIVDAEDVITQIPAVKARELKYGARVIKGLGYTGGDLVSIAPNGLCELYVSFPNVARRYQVRVHYACQDSTKIKLRIGDSSHDIKLQSTYSGGALTYDSFGYATSEYSYLFYPDFYDEKQIVRLGNDFDITQQDIIIDKIEFIPVDIFYAEEQALKQARKAVNALFTGAAKDVLKLNVTDYAVDQAANLVECVSDEFHAQEKMILLDQVKFAK

SEQ ID NO: 227 - DNA, 2058 bp, Bacillus thuringiensis
atgaacttaaatgataataagaatgaatttgaaatcatgggtaatggtagcatgtcctatcagccaaggtatccccttgcgcaggcaccaggttctgaattccaagggatgaattataaagattggatgaatcggtgtgcaaatggggagttaggagaattatttgtagattcagatgctgtgaaaaatggggtcgttgctggtctagctattacatcctatcttctcagtataccatttccttttcaatcagcagcattaggcattattagtgtactattaccaatactgtggccggagcaggcgggaaatcctggaactacggaagcacaatttacgtgggaccaatggatgaaggctgcggaaaaaatggctgatcaaaaaattgcagattcagtaaaaacaagcgctatcaataccacaaaaaccttacaatcacgtattgctgattataaacaagcaatttgtaatttaaaaacagatcccaataatgaggcatataaagaggaagtaagaaggcaatttaatgatgccgacgattgggcgaaagccactgtaatcgaatttggaaattcggcctatgcgattccattattagctgattacgcacaagcagctaatgtacacttacttttattacaagacggcataaaattcggagaaagctggggattttcggctcttaaagtgcaacaattgtattctaataccagcgtaggaaaccctggcatgaaagaactattagcaatctatacggatcattgtgtacgttattataatgaggggttaaagaagagatacgaaacgggcaactggtatacattcaatgattaccgtaaaaatatgaccctaatggtaatggatatcgtgtcattttggccaacctatgatccaatactctatccagttcctactaaatctcaactgacacgaactgtgtatacagattttctaagagacaccatttcgccccctgcaatctcagatgtagaaaatagtgtaactgttcccctaggcctatttagatggatgagtggactgggatatcacggagtaacagttaattcaagtaatgtttggatgggtctggaacagctctatcattatacgctgagggacgaccggtacgaggagaggcagggtgagtttccacatgattcaaaattattgggatatcttacaacacccaatgatgatgtttggtcgattataccaaattatatccctatagaggatggctctgaagttgggtatattcctaacaccgcgagtttctttcatgactttagatttcagcttcttaaaagtggggagcagagagtacatttagcgtacgaggaggggatatccagaaagttcggattaccttgtaaatcgaataccgggacggattgtgatccttgtcaaccttgtacggcacttcctaacgcaagcgatccttgtgatgacaaatcactttatagtcatcgattttcgtatatgggtatatacaatccttatattgagtttaccttgtccccttgctttggctggacacatgtaagcgcagatgcaaacaatctgatagatgcgaaaaagattacccaaattccagcggtgaaggcatacgcaattgctacaaatagtagagtcgtaaagggccctggtagtacagggggggatgtagtccaactttctagtggaaccgaaagtgggattatagccatgtggataacaacgccaccaggagctcgtgcatatcgtgtaagaatacgttatgcgagtagtatgcagacaaacgtagaaatttatatgttaggagctaacggacagtttgacgttccagctactacaactgatctgacaaatctcacgtataataaatttaaatacctagacaccgttgtttactcttattctcaagttgaagagaatagagaacacataagaataggggctactggttcaggctcaggttctttcattctcgacaaaatcgaattcattccaatcggaggttccgtggaagaatttgaagcgaatcaggctttagaaaaggcaagaaaggaagtgaatgct

SEQ ID NO: 228 - protein, 686 aa, Bacillus thuringiensis
MNLNDNKNEFEIMGNGSMSYQPRYPLAQAPGSEFQGMNYKDWMNRCANGELGELFVDSDAVKNGVVAGLAITSYLLSIPFPFQSAALGIISVLLPILWPEQAGNPGTTEAQFTWDQWMKAAEKMADQKIADSVKTSAINTTKTLQSRIADYKQAICNLKTDPNNEAYKEEVRRQFNDADDWAKATVIEFGNSAYAIPLLADYAQAANVHLLLLQDGIKFGESWGFSALKVQQLYSNTSVGNPGMKELLAIYTDHCVRYYNEGLKKRYETGNWYTFNDYRKNMTLMVMDIVSFWPTYDPILYPVPTKSQLTRTVYTDFLRDTISPPAISDVENSVTVPLGLFRWMSGLGYHGVTVNSSNVWMGLEQLYHYTLRDDRYEERQGEFPHDSKLLGYLTTPNDDVWSIIPNYIPIEDGSEVGYIPNTASFFHDFRFQLLKSGEQRVHLAYEEGISRKFGLPCKSNTGTDCDPCQPCTALPNASDPCDDKSLYSHRFSYMGIYNPYIEFTLSPCFGWTHVSADANNLIDAKKITQIPAVKAYAIATNSRVVKGPGSTGGDVVQLSSGTESGIIAMWITTPPGARAYRVRIRYASSMQTNVEIYMLGANGQFDVPATTTDLTNLTYNKFKYLDTVVYSYSQVEENREHIRIGATGSGSGSFILDKIEFIPIGGSVEEFEANQALEKARKEVNA

SEQ ID NO: 229 - DNA, 2748 bp, Bacillus thuringiensis
atgagtacaattttcggtgtagatactggtgattcatctattgatgatgtgttgaacaatgaagaattgttacaagaaatgttggaccaaatgaatacaatgcaaatttcaatacgagacatattggagcaacaaggtatttctgcagatatagaaaagcagattttagctctcacaacagaccttgctacatcgattaatacagagcttgtgaagattgaaggaattcttactacgtatctaccagctattagtaacatgttaagcaatatatatgaacaaacatctgtgattgaccaaaaagttgataagctcatagctttgatgacatttgctttaaaagaacttgattatattaaagataatgtagtacttaattcgagtattgtagaaatcacaccacatgttcagaaattagtctatgtaaataaaaaattcctttctctaacaagagactttttacaaggtgaagatgtaagtatagatagtatgcaagaaatacaggaatgggcaaaatcgatactagcaactgagatgaatagctttgaattttcagttgatacattacacagtattataatcggtgataacctttataaaagatcggcgttaaaaacattttcagatgttttattagatgatgtcgatcaatatggtgattttggtacaccgttagcaaagttttatacatttttctcttcattagcaacattacaaataaatgcgtatctatgtctaactttcgcaaggaaagttttagggctctcagaaattgattaccaggtaactatgagagacagaattgaacaacaaaatcaaatgtttgtaaacttaattcaagataagaactattccaatgcccttgaaattacaggaatatatcctatgtcattggataggggagattgtaaatcgacagatttacaagcagatgctggttgtgcgcttattggtttagaatttttcatggacaatggtatatataaagcaaaagcttaccaggggaaaatcggaaaaaacttttccgtatctgctgatacagtaacagagcttattagtgatgatttaagcactttgtttcatgatacgacaaacgacaatccagaactagatgtagtatatcctttatcaggagagctaacaggcccacctaatacgataataactcggataggacttggtacaaaatacgataaaacccgaggatcaagtgttcaggcatttgcatatatagatactgacttttcaccctatgattatatatctggcactattagtaaagaagggacgcaaacagtttcattagaagggaatgaccataaaaataggggatatagtaattggcctataggtttaattggagacctctacatgacacctttaaaaagtctatcattaaacgttgaagatactggaaccacccttaatatgagtggagaatcttatttttctacaatcttgtctagggaatataatactaattttatacttttcccttacacaaataatagtagtccaattgctgaaaatcttattcaaaatggggactttgaaaatggtgataagtattgggaagtagtgacaggatcagcagtaatagctgagggtgaaggaatttatggttcaaatgcaatgaaaattagtcatgttattaaacaagaattgaatttaaagccatacactacttatgaattaacagcatacgtacaatcaaatgttaacgatatacaaggcggaacgatttctataacatacaataacgttgaaatcgcccggacaaaaaaaactttttctacaagttataaacaaattgaactcaaatttaggactggagcagagaatcaagatttccatgttacttttgaaaaaaaccttgaaggctacctattattggataatataaagctccaagaaattccacaaacagataacctaattgattgtggagattttggaggcaatgatatcctaacttctgattataagctttggcgatacgcttatctttgggaacttgatggtggggcaaatttaacccaagaaggtttattcaaaacgttatgtttaaaaattttacaaagtggaggagccaatcaaaaagtacaattgaaggcaaataccaactatatattaacaacttatgtaaaagtagatgatcctactacgacagcacaaatagggtgtggaagtaaccaggtaccatgtaattcaacatcttatacaccactcaaactaaagtttagaactggtgaagatccttcgactacagaaagctctgtatattgttcaaactctaatgatagcggtacagtttgggcagataactttgtgttatatgaagttccgaatttaattaaaaacggggattttgagcaattcgatcaatcatcttggactttctctccttctgagggtgggagaatttacttgcaaagtggtctagggatgtctcgttctaatgcagttgtactgcaaggtcaaaacggacaaattagccaaaaggttccattgaaaccatttactaaatatcgattgacagcatatgtaaaagtatcaaaagatagtatagcacatattggctatggcgataacacatgtgcatgtgctgtagatgatttcagacaagctcttgtagattttacaactggtgctaatcctatgcaatccgatgatgctatatacttatcctctggtaatagcaaatatactgttgctgacaactttgaactttacgaacttgaccagatt

SEQ ID NO: 230 - protein, 916 aa, Bacillus thuringiensis
MSTIFGVDTGDSSIDDVLNNEELLQEMLDQMNTMQISIRDILEQQGISADIEKQILALTTDLATSINTELVKIEGILTTYLPAISNMLSNIYEQTSVIDQKVDKLIALMTFALKELDYIKDNVVLNSSIVEITPHVQKLVYVNKKFLSLTRDFLQGEDVSIDSMQEIQEWAKSILATEMNSFEFSVDTLHSIIIGDNLYKRSALKTFSDVLLDDVDQYGDFGTPLAKFYTFFSSLATLQINAYLCLTFARKVLGLSEIDYQVTMRDRIEQQNQMFVNLIQDKNYSNALEITGIYPMSLDRGDCKSTDLQADAGCALIGLEFFMDNGIYKAKAYQGKIGKNFSVSADTVTELISDDLSTLFHDTTNDNPELDVVYPLSGELTGPPNTIITRIGLGTKYDKTRGSSVQAFAYIDTDFSPYDYISGTISKEGTQTVSLEGNDHKNRGYSNWPIGLIGDLYMTPLKSLSLNVEDTGTTLNMSGESYFSTILSREYNTNFILFPYTNNSSPIAENLIQNGDFENGDKYWEVVTGSAVIAEGEGIYGSNAMKISHVIKQELNLKPYTTYELTAYVQSNVNDIQGGTISITYNNVEIARTKKTFSTSYKQIELKFRTGAENQDFHVTFEKNLEGYLLLDNIKLQEIPQTDNLIDCGDFGGNDILTSDYKLWRYAYLWELDGGANLTQEGLFKTLCLKILQSGGANQKVQLKANTNYILTTYVKVDDPTTTAQIGCGSNQVPCNSTSYTPLKLKFRTGEDPSTTESSVYCSNSNDSGTVWADNFVLYEVPNLIKNGDFEQFDQSSWTFSPSEGGRIYLQSGLGMSRSNAVVLQGQNGQISQKVPLKPFTKYRLTAYVKVSKDSIAHIGYGDNTCACAVDDFRQALVDFTTGANPMQSDDAIYLSSGNSKYTVADNFELYELDQI

SEQ ID NO: 231 - DNA, 1125 bp, Bacillus thuringiensis
atgcgaaaacgttataaaaagttagctactattataccgcttacaagtatgttaagtatgtcagcgattgcggttgcaccggctacatcttttgcagcggaaacacaaaaaaacgaagtttcactacaagaaggaacggcccagggttacctaatggaaaatggtaagatgacccctgtgtacaaaaataaacttactaagtttgatacagacggcgatatcgatcctggccttccactactcccagagaatccatataatccaattcctgatcatggaactgcatatgttgaatcaaccgatataggagatactgtatatttcaaaccatttgacacccctcaaaataatgtattagcgttaggtgactctgatgataatacttctcagtgggccgtagttgtagattcaaagaaatataaaagtgtaggatactttgttcaaaaacaagccgatggtcaaattagagttggatattataatccagaagatttatctctgattacagattcaaactatgctttcgcaggagtaccaggtttcggactgtcagcagaagcgaaagctaagatgcaacaagatttaaatcgagcatatggcgatatatgggatggcacaagtaaactaaaacgagaaacaaactataaacttctgccaaatgcctcaggtctacaggatgacgcatcggcatttggttataatcaaacgttaacttcgggtgtatcaactacaaatatgtttggaatagcgacaacagttgggtggaaaatggggataaaagtatcggttgttcctcttgttgcagacgttacgtcagagattagtgcaagtttaacagctagttatcagcatactgtaaacgtttcaaaccaaacgagttcgcaagtaaaatttgacatatcaagagtagataaccctgactataagtataatgactatgcggcagctgtatacaaaatacaaacagactatacattagaaccgggtaaaggattatctcgtgttgtagcaaagcaagatcttaaagatcctgtgcgtacagctgcattagcaaatacgaattatgcatatgaaggttcaaaatactactttacagtaacacctggatcacacaagaaaagtgtg

SEQ ID NO: 232 - protein, 375 aa, Bacillus thuringiensis
MRKRYKKLATIIPLTSMLSMSAIAVAPATSFAAETQKNEVSLQEGTAQGYLMENGKMTPVYKNKLTKFDTDGDIDPGLPLLPENPYNPIPDHGTAYVESTDIGDTVYFKPFDTPQNNVLALGDSDDNTSQWAVVVDSKKYKSVGYFVQKQADGQIRVGYYNPEDLSLITDSNYAFAGVPGFGLSAEAKAKMQQDLNRAYGDIWDGTSKLKRETNYKLLPNASGLQDDASAFGYNQTLTSGVSTTNMFGIATTVGWKMGIKVSVVPLVADVTSEISASLTASYQHTVNVSNQTSSQVKFDISRVDNPDYKYNDYAAAVYKIQTDYTLEPGKGLSRVVAKQDLKDPVRTAALANTNYAYEGSKYYFTVTPGSHKKSV

SEQ ID NO: 233 - DNA, 2271 bp, Bacillus thuringiensis
atgaaaaaggtaataacaaagtcttcttttgcatgcattttaggagcattgttcttattatcaaatcatatttcagtttttgcagctgaaaaccaagattctccaccgagtgctatcaaactggataatatttttactgttccttcagggtccaacagtatacttatacaaaatgataagttcgatatcgttcagttaacagacagtgtcaaggatcagagtggagcggtttggtcaacagacgaaaataaaatggatttaacaaaagactttgaagcagcaatgtatatctattttggtgattctggtgaagatgctgctgatggaatggcatttgtcatgcataacgacaaaaatggaaacaatgcttttagaactggggaaggtgctaggataggtgtatgggattctacaaagcctaaagaattcggcttggcaattatgaattcttttgcagtcgaatttgatacctactttaacaaagattttgatagaggggttccaaagcagaatcatatcgcatggaactatccggggaaaaaagatacatatgatgattcgggattaatctttaaagaccgaagaatgattcataatgatcttcagtttccaggtctattatctaatgatacttggcgctattttacggttaggtgggatagcaagcagagtatattaacgtatcaactccaaggattaaaaagcgtttcggttcctattaatgtgaatgatgtctttgggacaacagaagtgtattggggctttaccggttctacaggtgggagctttgaaatgaatcgaatcgtattcgataaggtaccagggcttgttgaggctgaggtaaaagaagacattctagatattacgactaatgaaagtgtagtaggcacaaaagttgctagtggtacaaagttaacgtatagcctggaagcgaattatattggtggtaagcaagcatggaaaaacattaatgtatcaagtacgattgatagcaatgtgagttacgttcctggaagcctaagattgaaagacgcatcaggtaaagagactcctttggatgattcctattggaaggatggtatgttaaacgcacccatctcagatatggatttaaataattcaaagcaaacgattctgtttgatgtaaaaacaaataaggttggacaggatacagtggtaagtgagcatagtaatttttatggagacaactaccatacaaaaactgcagaattaaattatacaattagtgcaaataaggcgcctgaaataagtttgaatcaggaaaatgaaacaataaaagtacctatgggtcaagatgttgaggtaagtgggaaatggaaggatgaagatggtacaaaagtcacaattacatataagttaaatggtgaagtaattggtcaaaatcagcttcaatcagaacaggaaaacactttccaagattggaaatatacgattccaaaggacaaactacaattaggagtaaaccacttagaagtttatgcaacagatgaaaaaggtgctaattcagaagtgaaaagtttagaaatatctatatctagtcctccaacaataactctaactgaggaaaataaagaggatgagatagattatggtaaaagttttaatttctctggtactgtgagtgatttggatggtgccgataaagaattgacgctctattacgtaatcgacgataacgagcaggttgctttttcgaaagttactaatagtaacccgggagaagcaattaattttgcaggagaaatccctacttcgaatgtgaatgaggggcctcatacgatttcagtttatgctattgatgaagatggtttacaatctaatattagcaaatttactttacatgtaataaaacgattaacttttgccgatgacatgaaggatgtcgagtttgtcacgacacaaattggttctacgccaaagattagcgaacgaacaacagagtatccaattcatattattaacagtaaggggaaaggaagtaagtggaagctaaaagcggaacttacaaaacctcttgtttcaaaagaaaaccatacattagaaggcttattctttaaaaagtctaatggagaaacagaagaactattattaaatacttccgttattgtggagactggtgaatccccagaagactattcagatattaatctaaattggaaaaatgatgaagggctattactaaaggtagatccatcagcgcatataggttcatatgctggtgaattaacatggactttagaggatgcgcct

SEQ ID NO: 234 - protein, 757 aa, Bacillus thuringiensis
MKKVITKSSFACILGALFLLSNHISVFAAENQDSPPSAIKLDNIFTVPSGSNSILIQNDKFDIVQLTDSVKDQSGAVWSTDENKMDLTKDFEAAMYIYFGDSGEDAADGMAFVMHNDKNGNNAFRTGEGARIGVWDSTKPKEFGLAIMNSFAVEFDTYFNKDFDRGVPKQNHIAWNYPGKKDTYDDSGLIFKDRRMIHNDLQFPGLLSNDTWRYFTVRWDSKQSILTYQLQGLKSVSVPINVNDVFGTTEVYWGFTGSTGGSFEMNRIVFDKVPGLVEAEVKEDILDITTNESVVGTKVASGTKLTYSLEANYIGGKQAWKNINVSSTIDSNVSYVPGSLRLKDASGKETPLDDSYWKDGMLNAPISDMDLNNSKQTILFDVKTNKVGQDTVVSEHSNFYGDNYHTKTAELNYTISANKAPEISLNQENETIKVPMGQDVEVSGKWKDEDGTKVTITYKLNGEVIGQNQLQSEQENTFQDWKYTIPKDKLQLGVNHLEVYATDEKGANSEVKSLEISISSPPTITLTEENKEDEIDYGKSFNFSGTVSDLDGADKELTLYYVIDDNEQVAFSKVTNSNPGEAINFAGEIPTSNVNEGPHTISVYAIDEDGLQSNISKFTLHVIKRLTFADDMKDVEFVTTQIGSTPKISERTTEYPIHIINSKGKGSKWKLKAELTKPLVSKENHTLEGLFFKKSNGETEELLLNTSVIVETGESPEDYSDINLNWKNDEGLLLKVDPSAHIGSYAGELTWTLEDAP

SEQ ID NO: 235 - DNA, 1224 bp, Bacillus thuringiensis
atgaatgataatatggatggaagtcaaaatggagatacaataactactgaagattctttagcaaatgacgaaagaaatacaagtttaccagaagaaagtcgtaaatttgcatattatcaacccttaagtacaaataatcaagtatggcacgtatatacacatggtggtcttcctatgccaattcaagcatgtgaattaagctattttcctcatgcattaacaaatcgaccatatcaaggaggacaataccaacaatttatttggtttgaactcgatgatggtcggtttgcaattgctgatagacactatgggcatgtattacaaaggtatgagtactatgatgcgaaggaaatagttattagaccatgggaaaataattatgctcaactttggaggaaagaaagcacttcagctactacttttagattagtaaatgactcgtacgcattaaatgtatgtggaaatgagactaacaacactgtcaagtatacctttgtgcctaatgattcaaataatagtgcacttcaatttaagcgtagagcaattgctcaagataatgtagtaccagctttaccatcaaaacaaccattaccacctcttccagttttatcaaatctaaatgatccagctcctcatgaaacggtaagaaatataactggttcttctctaataccttgtattatggtatcggattatatccctgtatctcaaagaataaaagagagtccatattatatattggttaaaaaacaattttggaaacgtttatggcatgatacgtttattccaggtgaaggacgtgcatttgaagaaacaactggtatgtcatcaactgagcaacaaagtatgacacaaactacaaatatatcgttgcaagccgattttggctttgcatataaagccctaacactaggtataggagtaagcgtttctaaatcaatagaaataagtagaagtacaacggatacagtaatgagtcaaagtaaagatacacaaagttataaaaacgaaaatccgtttgacctatcatgggctaaatatgctttggcaactgagtttattttaatgcgtaaggatggtactaaagcaggttcatgggaagctgttgataaaaaaatctcaagatctatatcctatccacctactcaaaatctatcttggtttgaggatacaggaaacaaaaaggataacactgattttggattgactacaataacatctgaa

SEQ ID NO: 236 - protein, 408 aa, Bacillus thuringiensis
MNDNMDGSQNGDTITTEDSLANDERNTSLPEESRKFAYYQPLSTNNQVWHVYTHGGLPMPIQACELSYFPHALTNRPYQGGQYQQFIWFELDDGRFAIADRHYGHVLQRYEYYDAKEIVIRPWENNYAQLWRKESTSATTFRLVNDSYALNVCGNETNNTVKYTFVPNDSNNSALQFKRRAIAQDNVVPALPSKQPLPPLPVLSNLNDPAPHETVRNITGSSLIPCIMVSDYIPVSQRIKESPYYILVKKQFWKRLWHDTFIPGEGRAFEETTGMSSTEQQSMTQTTNISLQADFGFAYKALTLGIGVSVSKSIEISRSTTDTVMSQSKDTQSYKNENPFDLSWAKYALATEFILMRKDGTKAGSWEAVDKKISRSISYPPTQNLSWFEDTGNKKDNTDFGLTTITSE

SEQ ID NO: 237 - DNA, 1980 bp, Bacillus thuringiensis
atgagtccaaataatcaaaatgaatatgatattatagatgcaccatctcgtacgtctgtatccaatgattctgtcagatatcctttggcagaggaccccaatgccgcattgcaaaatatgaattataaagagtatttaagaatgtctggaggaggtgacactggaaatttagcaaacatgcaagagtttattgatactcaatcagctattaatactgccatttctattattggaagtatagcggatgcatttggtattcccggtgtatcttttgtcggcggccttattagttcacttctcgatttattgtggccatcagggccaagtgtatgggaattgtttatggaacaagtagaagcgttgattaatcaaagaatagaacaaaatgtaagaaatgaggcaattagccgattagaagggttagctagaatcttagaattatatgggacagcatttgaagagtggcgggaaaattcaactagggcaagaatggaataccttcaaaatcaatttcaaatcgttgataattttttcacagcatatatgccaacttttcgatctactaataatgaagtggcattacttacagtatatgcgcaggcggcaaatcttcatttgctattattaagagatgtttctatttatggagaacagtggggatggaatcaaaatagaataaataattattataatcgtcaaatgcaacttacggctgaatatactgatcattgtgtaagatggtataatacaggcttagagagattacgagggactactgctcaacaatgggtacgttttaatcgttatcgtagagaaatgacgttaacagtattagatactatagcaatatttccaaactatgacattcgtacgtacccaattggaacatcatttcaacttacaagaaatgtgtatacagatccaattggttttgaaggtacgccgccagatacttggttgaatcaggcaccttcctttacgaatatagaaaatagtgtttttcgtttcccccactattttgatacaataacgaatcttaccgtttttactaggcgttcgttatggagttcatctgtgtttatgaatctatgggcagggcatagaataacatctcgacgtatccaggatggtgttttatatacaagtgtgcatggagtaactactaaccctgttagtactagtgaattcatttttgaaggtctggatatttacagaaccgtatcaagagcaggtatactagctactattagtgcaagaaattttggaatgcctacagtggaattctttacgttaactggtggtggtttcccattcaattttgagtacaatcctggattttcaaatattgtaacacagctacgagactcattaaatgaattacctctaatagaagatggatctcaatcgatgcaggaattgtttagtcatagattatctcatattggaatgataccaaatgtagctgtgcctgtgtattgttggacacatcgaagtgctgatagaagtaatcgattgcatggagatagaattactcaaattccagtagcaaagggctacagcggtagagctttgtctactggtcctggttttactggaggaagtataatctcaacagcatttgaaggtgatttggttaatatagggttttcgagaagcgagtcagtaccaatatcacaacgatatcgtgtaagagtgcgttgcggtgctgctggtgctgacgcacgaattagggttacgattttagggggtcgtactattgaagctagagttcctcgcactatagatataagtcctaaccgtccatatgaaacatttacttttgtgacttttgatgatatagttacattttcttggctacctcatgcaacaataagttggcaacctattaatccgtctgatatttcagtaatctttgtagatcgaatcgaattcattccagtagatgaaacatttgaggcggaacaagatttagagaaagca

SEQ ID NO: 238 - protein, 660 aa, Bacillus thuringiensis
MSPNNQNEYDIIDAPSRTSVSNDSVRYPLAEDPNAALQNMNYKEYLRMSGGGDTGNLANMQEFIDTQSAINTAISIIGSIADAFGIPGVSFVGGLISSLLDLLWPSGPSVWELFMEQVEALINQRIEQNVRNEAISRLEGLARILELYGTAFEEWRENSTRARMEYLQNQFQIVDNFFTAYMPTFRSTNNEVALLTVYAQAANLHLLLLRDVSIYGEQWGWNQNRINNYYNRQMQLTAEYTDHCVRWYNTGLERLRGTTAQQWVRFNRYRREMTLTVLDTIAIFPNYDIRTYPIGTSFQLTRNVYTDPIGFEGTPPDTWLNQAPSFTNIENSVFRFPHYFDTITNLTVFTRRSLWSSSVFMNLWAGHRITSRRIQDGVLYTSVHGVTTNPVSTSEFIFEGLDIYRTVSRAGILATISARNFGMPTVEFFTLTGGGFPFNFEYNPGFSNIVTQLRDSLNELPLIEDGSQSMQELFSHRLSHIGMIPNVAVPVYCWTHRSADRSNRLHGDRITQIPVAKGYSGRALSTGPGFTGGSIISTAFEGDLVNIGFSRSESVPISQRYRVRVRCGAAGADARIRVTILGGRTIEARVPRTIDISPNRPYETFTFVTFDDIVTFSWLPHATISWQPINPSDISVIFVDRIEFIPVDETFEAEQDLEKA

SEQ ID NO: 239 - DNA, 2073 bp, Bacillus thuringiensis
atgaaccaatactatagaaatgatgaaatggaaattctcgatccaggaatgggccagcccagatatccgtatgcacggcccaattccgagttacaatcgatgcattacaaagattggctagatatgtgtgaaagaaatggaaacggtctcacaacattacgacgaggtacattggcatctgcacaagacatcattactgttagcttagatattcttggtaccattttgggatttatacctatagtaggtggagctttatccgcaggcgtttccatacttaactccataattggattactttggccagaaccagaagaaccaggaattccaacagatccaaatgcaatatggatagaatttatggaaaaggtagaacaactgattgatcaaaaaatttctcaagaagcatttaatgcagcaattggaaggttgacaggcttaaaacgagctttaaatttatatcaagtatcatttgaactttgggctgacgatcaaactgatgaagagttaaaagaggatgtacgaactcgatttacagcggccctctttgaaatggtggctacaatagaaacgtttagatatcctggacaagaggtaaacctactcacagtgtttgcacaagccgcagatcttcacttgttgctattaagagaagggattatgtatggattacaatggggttttgatcaaagaacagttgattctttttatacaaattctcaaaaagaagggctaaaagatttacttcctatatatactgatcattgtacctattggtacaatgaaggtttaaaaataacctataacttgaagccggatttatcaaatactgaaagatatccatgggctgcaaataaaccttcatggaacattcaagttcttgaagaattagaaggttggaatctatttaacgatttccgaagagatgtgacgattatggcattagatttggttgcattgtggccaacttatgacctatattattatgataatttgaagtatggtgtaaaaactgaacttacacgtccagtgtattctcaagcggctggaaccagctggggcagcatattaccaagggatcgctatgaacaaggtatagtccgttccccacatttagtgacattgttacaatcaattgattttaaattaaaccctggtccattcactccgagtaatagctatcaacattatacaggtcttcagctgaaatattattattccggccgagattacacaatacatgcatcgccactaataggtactacgtcttctagtgggaaaacaattaatgtggacggtaaatctgggtctgttatttatcaatcagatattaagcataacgatgccgtatatacaatggagttcaagaaaactaatgggagcagtgaacaagttgggtatacgtataatcctaattattctacattgtcatggcctcctgagactgatgtttccaattatggtcatcaaatgtcttggataagtggcccagtagagctaaatactatcccagcttttggtgtagagtggctacatgaaagttgctctccttttaatgttatagcggatgacacagtagaaaatcctatcattactcaaattccagcagtgaaaggggcaagtatatcaggaaatgcaacggttataaaaaatcctggtcatacaggtggtgatctcgtacaattacctgcgaattctggatcacaggctcaattgttcataactgtggaaactcctccttcgaagatagggaaaacctatcaaatcagagttcgctatgcggctagttccgctgctgccttacaagtgaatcaatgtaattttagtggaggaagttgttataacacagcatctattgcggttccagctacgtattctaataatgcattattgtataatgcatttcagtatgcagatgtgttcccgataactatacaaaatattgacttttccttacagtttttcaacagaagtggtggacctattatcctcgataaaatcgagtttattccaatagaaggttccttagaagagtatacagcgaaacaagagttagagaatgtgagaaaggca

SEQ ID NO: 240 - protein, 691 aa, Bacillus thuringiensis
MNQYYRNDEMEILDPGMGQPRYPYARPNSELQSMHYKDWLDMCERNGNGLTTLRRGTLASAQDIITVSLDILGTILGFIPIVGGALSAGVSILNSIIGLLWPEPEEPGIPTDPNAIWIEFMEKVEQLIDQKISQEAFNAAIGRLTGLKRALNLYQVSFELWADDQTDEELKEDVRTRFTAALFEMVATIETFRYPGQEVNLLTVFAQAADLHLLLLREGIMYGLQWGFDQRTVDSFYTNSQKEGLKDLLPIYTDHCTYWYNEGLKITYNLKPDLSNTERYPWAANKPSWNIQVLEELEGWNLFNDFRRDVTIMALDLVALWPTYDLYYYDNLKYGVKTELTRPVYSQAAGTSWGSILPRDRYEQGIVRSPHLVTLLQSIDFKLNPGPFTPSNSYQHYTGLQLKYYYSGRDYTIHASPLIGTTSSSGKTINVDGKSGSVIYQSDIKHNDAVYTMEFKKTNGSSEQVGYTYNPNYSTLSWPPETDVSNYGHQMSWISGPVELNTIPAFGVEWLHESCSPFNVIADDTVENPIITQIPAVKGASISGNATVIKNPGHTGGDLVQLPANSGSQAQLFITVETPPSKIGKTYQIRVRYAASSAAALQVNQCNFSGGSCYNTASIAVPATYSNNALLYNAFQYADVFPITIQNIDFSLQFFNRSGGPIILDKIEFIPIEGSLEEYTAKQELENVRKA

SEQ ID NO: 241 - DNA, 1980 bp, Bacillus thuringiensis
atgaatcaaaattataataataatgaatatgaaatcatggataatggtgttcagtgctgtacaccaagatatcctcttgcgcaggcaccaggttctgaactacaaagtatgaattatcaagatgtgacggaaacgagtatcggaagagaataccaggcagtacaacaggtaaatgtgggagaggctgttagtgccgcactgggcattctgacaactattcttaaggcagccaatccaatattggggacagccgcaggggtcatcagctcgattttcggatttctctggaaacgatttggaacagatcctcaatcccaatggaaacagttcatggaggcagtagaatatctggtgagtcaaaaaattacagacgcagtacgaagtaaagccgtttcggaattagagggtgtacaacgagctgtggaactttatcaggaagctgctaatgcttggaacatgaatccggatgatgcagctgccaaagagaggataagaagacaatatacctctacaaatacagtgattgaattcgcaatgccatcctttcgagtgggtggttttgaggtaccgttattaacggtgtatgcgcaagctgctaaccttcatttactactattgcgagatgcggttaagtttggagcgggatgggggttttctcctacagaagttgaggataattatactagactccaagcacgtacagcagaatatacaaatcattgtacaaatacctatgataaaggtttaaagcaagcatacgacttagcaccgaatccaacagattacaataagtacccctatctaaatccatattctaaagatccgatttacggtaaatattatacagctccagttgattggaatctatttaatgacttccgaagagatatgactctgatggtgctagacattgtggcagtttggccaacctataatccaagactatataacaatccgaatggtgtgcaaatacagctttcaagagaagtttatagcacggtatatggaagagcttggtctaataattcaacagttgatgtcattgaatctacccttgttagacctccgcatttagttacggaactaaccaagctaacatttgatgagcgtaatttatatgaagcggaaacagtgcctgttgcgtttagaagggttacaaatacgcttcataatgtaggaagttcaaccacatgggagcaaagtttttctgcgacttctgttggatcaattaaggctgttcataatgtcgcggctaccgatataggtaatcttgcactaagtctaggagctgtacctttgggtttttctttctataataaaaatgatcaacatctaactacagtgggctactctggaggttggtggaatgggatacctaaagacgaaggtagtaatcaaaacagtcatcatctgtcatatgttgcagccctagaaacgcagagtacagctggttggtggccttatacgtatccggtgcctttattaggagaatggggatttgggtggttgcataatagtttaacaccaaccaatactatagtaagtgataaaatcactcaaattccagcggtgaaggctttcaaactcacaccatacaatagcaataccaaagttattaagggtcctggtagtacaggaggggatctaatccagttagcttctggctttttacaatatagtttcccttcaaccgacaatcgacaataccgtattagaattcgttatgcaagtacgaatggtagtactctaacactcaaaaaatgggttggtaatttctataccagctctaatcataatcttccatctacgtattctagtggcccattaacatataatacatttgccatttttgatactggacacattattcgagagacaagtggattcgaactttggttagataatataggtagcggaaccctaatcatcgacaaaatcgaattcataccgattgaggggtctttagaagcgtatcaagcg

SEQ ID NO: 242 - protein, 660 aa, Bacillus thuringiensis
MNQNYNNNEYEIMDNGVQCCTPRYPLAQAPGSELQSMNYQDVTETSIGREYQAVQQVNVGEAVSAALGILTTILKAANPILGTAAGVISSIFGFLWKRFGTDPQSQWKQFMEAVEYLVSQKITDAVRSKAVSELEGVQRAVELYQEAANAWNMNPDDAAAKERIRRQYTSTNTVIEFAMPSFRVGGFEVPLLTVYAQAANLHLLLLRDAVKFGAGWGFSPTEVEDNYTRLQARTAEYTNHCTNTYDKGLKQAYDLAPNPTDYNKYPYLNPYSKDPIYGKYYTAPVDWNLFNDFRRDMTLMVLDIVAVWPTYNPRLYNNPNGVQIQLSREVYSTVYGRAWSNNSTVDVIESTLVRPPHLVTELTKLTFDERNLYEAETVPVAFRRVTNTLHNVGSSTTWEQSFSATSVGSIKAVHNVAATDIGNLALSLGAVPLGFSFYNKNDQHLTTVGYSGGWWNGIPKDEGSNQNSHHLSYVAALETQSTAGWWPYTYPVPLLGEWGFGWLHNSLTPTNTIVSDKITQIPAVKAFKLTPYNSNTKVIKGPGSTGGDLIQLASGFLQYSFPSTDNRQYRIRIRYASTNGSTLTLKKWVGNFYTSSNHNLPSTYSSGPLTYNTFAIFDTGHIIRETSGFELWLDNIGSGTLIIDKIEFIPIEGSLEAYQA

SEQ ID NO: 243 - DNA, 1422 bp, Bacillus thuringiensis
atgaattcagaacaacgtaagcatgagcagaataatgaatataagcatcaaaatcatggtgtatcttgtaattgtggttgtcagcaaggtaaatatgaatacgagcaaaaacaaagtagggaagaatataacaatcaatatatgtcaaatggacaaaagcaaaatcatgaaaataaaaattattatagctgtagtccaacacaatttaatgcacctaatttacctgatgaaagcaaaagatttcaaacgattacaaatattaatacgaataataacggtcatcgtgttttagatgcaatgaacacgactgtggggcaagagcttgagaggggctatgggaattgttcaagggtaagtgttgcaaatacagtagttaatgaacaggttcgatttttgaataaatctcaactttttgttttttatcaagcagatgctggtgatttttttattgctaataaagggaatgggcgagtcttagaagttatacctaatagtacacatggatatttagtaatctctaatttgtatgatggtgctaataataaccaaagaattagaaaagaaaatgtaactactactaattttagattaagatcacaagatgcagtaataaatatatgtggtcacaacatcaataggttggtatcaattactgctatacaaagtactgccgaaacattattccgattcagacctgaaaacatggataatatctcgcttccaacactaccaactggaggaaggttaggattaccacctgtattaacgagtttgaatgattcaggtccaagtccaagtccaacaggtccaaatccagcaccacgagcaaatataggaagtgcattgataccatgtctatatgtaaatgatgtacttccaatagatagaagaatggaagtaagtccttattatgtattagaatatacacagtattggcatagattatggtcagatgaggttctttctggagatagaggaggaccttacgaagaaataacagggatacttcccaatgcacaagaaagcatgagaaatatgatagatatgacaataggtgaagattggggtttaagatttggaagtaactcgactccttttaagagggggattctaagtagcttaaataatctcgagtcctatgctgctagggatttaggatctagacattcgagttatggatttacaaatttcaatccatttccagttagatattcaagatttgtaaaagcgcatgagtatacattgaagcgtatggatggaacagtagtaacaacaccatgggtagcattagaccatagaagtcaatatttgcctagattccctctaaacgcgacagtatcattacaagattataaaataataagcagttatagcagttatgatttgccagtattagaaaacatcgatgttaataagagatgg

SEQ ID NO: 244 - protein, 474 aa, Bacillus thuringiensis
MNSEQRKHEQNNEYKHQNHGVSCNCGCQQGKYEYEQKQSREEYNNQYMSNGQKQNHENKNYYSCSPTQFNAPNLPDESKRFQTITNINTNNNGHRVLDAMNTTVGQELERGYGNCSRVSVANTVVNEQVRFLNKSQLFVFYQADAGDFFIANKGNGRVLEVIPNSTHGYLVISNLYDGANNNQRIRKENVTTTNFRLRSQDAVINICGHNINRLVSITAIQSTAETLFRFRPENMDNISLPTLPTGGRLGLPPVLTSLNDSGPSPSPTGPNPAPRANIGSALIPCLYVNDVLPIDRRMEVSPYYVLEYTQYWHRLWSDEVLSGDRGGPYEEITGILPNAQESMRNMIDMTIGEDWGLRFGSNSTPFKRGILSSLNNLESYAARDLGSRHSSYGFTNFNPFPVRYSRFVKAHEYTLKRMDGTVVTTPWVALDHRSQYLPRFPLNATVSLQDYKIISSYSSYDLPVLENIDVNKRW

SEQ ID NO: 245 - DNA, 1965 bp, Bacillus thuringiensis
atgacttcaaataggaaaaatgagaatgaaattataaatgctttatcgattccagctgtatccaatgagtctgttacaatctctaaagaatatgcacaaacaaatcaattacaaaacaatagcattgaggatggtttgtgtatagccgaaggggaatatattgatccatttgttagcgcatcaacagtccaaacggggattagtatcgctggtagaatattgggtgtattaggtgtgccgtttgccggacaattagctagtttttatagttttattgttggcgaattatggcctaaaggcagagaccaatgggaaatttttatggaacatgtagaacaacttgtaagacaacaaataacagcaaatgctaggaatacggcccttgctcgattacaaggtttaggagattcctttagagcctatcaacagtcacttgaagattggctagagaaccgtaatgatgcaagaacgagaagtgttctttatactcaatatatagccttagagcttgattttctaaatgcgatgccgcttttcgcaataagagagcaagaggttcccttattaatggtatacgctcaagctgcaaacttgcacctattattattgagagacgcctccctttatggtcgtgaatttgggcttacctcccaagaaattcaacgttattatgaacgccaagtagaaagaacgagggactattctgactattgcgtacgatggtataatacagggctaaataacttaagagggataaatgccgaaagttggatacggtataatcaattccgtagggacctaacattagctgtattagatctagtggcactatttccaagctatgacactcgcacttatcccattccaactagtgcccaacttacacgagaagtgtatacagatccaaacggtgcagtaagatcaagtaattatagttggtttacaaatgctgcttcattttcggctatagaaaacgcaattattcgacaacctcacctatatgattttataacgaatcttacaatttacacgagaagaagtcaagtaggtactgctattctgaatctgtgggcagggcatagaattacttctaatagaataggctctagtagtagtagtgaatcggtgtatggggctattactaacccagttagtactagtaacttatcatttgtcaatcaagatgtcttccgaactatatcattactcggcataaatggctctgtgagcggcctaatttatggcttaactcgagttgattttgatataagaaatcgtaactatactaatataacaaatagactaacttataatcctgggcatcaaaatattggaacacaaacaagagattcagaaactgaattaccaccagaaacaacagaacagccaaattatagagcctttagtcatctactaagccatatttcaatgggtccaaggactaaagacgcacctccagtatattcttggacacatcggagtgcagatcgtacaaatacgatcaattcggataggataacacaaataccattggtaaaggcacatacccttcaatcgggttccactgtagtaaaagggccagggtttacaggaggggatatcctccgtcgaacaagtggaggaccattagcttttagtattgttaatctagattttaacttttcacaaaggtatcgtgctagaattcgttatgcctctactactaacctaagaatttacgtaacggttgcaggtgaacgaatttttgctggtcaatttaataaaactatggaagctggttccccattaacattccaatcttttagttacgcaactattaatacagcttttacattccctacgagatcgagcagcttgactgtaggtgctgatacgtttagttcaggtaatgaagtttatgtagatagatttgaattaatcccagttactgcgatcttcgaggcagaaactgatttagaaagggcg

SEQ ID NO: 246 - protein, 655 aa, Bacillus thuringiensis
MTSNRKNENEIINALSIPAVSNESVTISKEYAQTNQLQNNSIEDGLCIAEGEYIDPFVSASTVQTGISIAGRILGVLGVPFAGQLASFYSFIVGELWPKGRDQWEIFMEHVEQLVRQQITANARNTALARLQGLGDSFRAYQQSLEDWLENRNDARTRSVLYTQYIALELDFLNAMPLFAIREQEVPLLMVYAQAANLHLLLLRDASLYGREFGLTSQEIQRYYERQVERTRDYSDYCVRWYNTGLNNLRGINAESWIRYNQFRRDLTLAVLDLVALFPSYDTRTYPIPTSAQLTREVYTDPNGAVRSSNYSWFTNAASFSAIENAIIRQPHLYDFITNLTIYTRRSQVGTAILNLWAGHRITSNRIGSSSSSESVYGAITNPVSTSNLSFVNQDVFRTISLLGINGSVSGLIYGLTRVDFDIRNRNYTNITNRLTYNPGHQNIGTQTRDSETELPPETTEQPNYRAFSHLLSHISMGPRTKDAPPVYSWTHRSADRTNTINSDRITQIPLVKAHTLQSGSTVVKGPGFTGGDILRRTSGGPLAFSIVNLDFNFSQRYRARIRYASTTNLRIYVTVAGERIFAGQFNKTMEAGSPLTFQSFSYATINTAFTFPTRSSSLTVGADTFSSGNEVYVDRFELIPVTAIFEAETDLERA

SEQ ID NO: 247 - DNA, 2244 bp, Bacillus thuringiensis
atgaattcatatcctaataagaatgaatgtgaaatattggatgattcactaaactactcgaatatgactaataattatcatcggtatccagtagctcataactcacaaacttctatgcaaaatacaaattataaggattggatgaatatgtgtgattcaaatactattaattatagaagcattgattctagtcctgaagcttatattttagcacgagctgccatttccattgggattggtattgtctctaaactattaagttatttaggtctaggaatattggcagacgcaattaacataacgacgtctcttgtaaatacactttggaaggaacagaataatacatgggacgccttattaatgcatgtagagaatcttatgaatcaaaaaatctccgatttagtactatctaatgcaaatgtagaattggatgctttaaaaagagttttaagtgaatataatgctgcgttagagaattggaaaaataaacccaatgatccaagtgctttagagcttatcaaatcacaatttacaattactcataatttttttgtgttacgcatgtctgtgttcgcacatccaggctatgaagtattattattatctgtatatgcacaagctgcaaatcttcatttactcctattaagagatgcaagtatctatgggaatcaatgggggctagctcgaagtaatggtgattattattatgagcggcaaatgtattatacgaatgaatacacgaatcattgtatgatgtggtatcgcaatggtttagatcgcttaagaggcacaacaggggcacaatggttgaattttaatcgattccgtacagaaatgacattgacagtattagatattattgcattatttccaacttatgattatcgaaactatcccgtatttacaaaaatcgagttatctagggtaatttataccgatccagtaatttatggtggattttcacaactccctagtaataatcttggcaatttcaatgatttggaaagagaagccataggtctcccttcttttatcaagtggttaaagaaaattgaaatatctactggagaaattagatttgctacgaatccgcatacaggtgattgggtagtaaatgtatggaacggtaatactaatacgtccgaatttacaaattcaacatcttacccatctcaagtagttgaaagccatggaataatgacaaatactcgtactactctaaatatggatactttggataactttagagtagacttacgtgcacattgttttagtcaaggagcacctttctacgatgtgtttggaatcggtcgttcacaattttttaatagagaaacaagcataatctatgattacggaatcggaataacagatcgttataaccggcatcgttaccaaaatataacaataagtttaccaggagcaaattcagaacaagcaactgaaaatgattatagtcatagactagcggatgtaagaaatctcacaggcggccttcgccaaaatactccacagatgaatatgggacgttcctctttaataggatatgggtggacacatgtaagtatgaaacgcgagaatagagtagaattagataaaatcacacaaattccggccgttaaagcaagtagtgcttccaattgcactgtaattccaggtcctggatttacgggaggccacttagtacgttttgattaccaaggaagattggatatgcaaattgaatttcctaatacacaaaaagagtatcgcatacgtatacgatatgcttctacagcgataaatacactatatttttcatttggtggaattactcgagggatagcatttagttctacaggtgcttcttcactagaaaatttgcaccatgagaattttgcgtatggcaatgttttccagggtattttcgatcccaccttaggtaatacattaattatttcaaattggactactgttgctccacgtatggtaatagacaaaattgagtttattccaattgaagcttttacaaatcaaccattaggagcagcaaaagaatataaaaacaactataatcaaatttttaataattacaacaagaacataaataatatggactaccagaataacaatgttatgtctcatcatgactatcacaatacttacaatcaagagtctaacgattataaccaggacaacaacgataattacaactcgaacgctggctgcacgtgtaaccaagggtataacaataactatccgaaa

SEQ ID NO: 248 - protein, 748 aa, Bacillus thuringiensis
MNSYPNKNECEILDDSLNYSNMTNNYHRYPVAHNSQTSMQNTNYKDWMNMCDSNTINYRSIDSSPEAYILARAAISIGIGIVSKLLSYLGLGILADAINITTSLVNTLWKEQNNTWDALLMHVENLMNQKISDLVLSNANVELDALKRVLSEYNAALENWKNKPNDPSALELIKSQFTITHNFFVLRMSVFAHPGYEVLLLSVYAQAANLHLLLLRDASIYGNQWGLARSNGDYYYERQMYYTNEYTNHCMMWYRNGLDRLRGTTGAQWLNFNRFRTEMTLTVLDIIALFPTYDYRNYPVFTKIELSRVIYTDPVIYGGFSQLPSNNLGNFNDLEREAIGLPSFIKWLKKIEISTGEIRFATNPHTGDWVVNVWNGNTNTSEFTNSTSYPSQVVESHGIMTNTRTTLNMDTLDNFRVDLRAHCFSQGAPFYDVFGIGRSQFFNRETSIIYDYGIGITDRYNRHRYQNITISLPGANSEQATENDYSHRLADVRNLTGGLRQNTPQMNMGRSSLIGYGWTHVSMKRENRVELDKITQIPAVKASSASNCTVIPGPGFTGGHLVRFDYQGRLDMQIEFPNTQKEYRIRIRYASTAINTLYFSFGGITRGIAFSSTGASSLENLHHENFAYGNVFQGIFDPTLGNTLIISNWTTVAPRMVIDKIEFIPIEAFTNQPLGAAKEYKNNYNQIFNNYNKNINNMDYQNNNVMSHHDYHNTYNQESNDYNQDNNDNYNSNAGCTCNQGYNNNYPK

SEQ ID NO: 249 - DNA, 2046 bp, Bacillus thuringiensis
atgaatccatataacaatgatctttataaaatctttgatccgaatacatcatcttataatttcagccagtatacaaataattctagatatccttatacctatgatcctaaacaaatacaacaaatcataaattatcagcaaacaatacagccggatctaacatactcaaaatatttagaaaatcctaaagcatttacaacggattggtctactatagctagtactagtataattataataggtaccttaattgcattaagcggtcctttagcgttacctggtgcaatccttatatcagttggtactgcacttcctcttctttggcctaatccacaagaaaatcaaacttggagagattttcttcaacaaggaaattctctattacctggaaaagaattacaccaatctacacaagaccttataataggaatgttaaatggtctacaatcaggaatagattattatctaagtgctttaaatacatggaaacaaaatccttcaaatcatcaacttactgaagaagttattaatagattcaacattgctcgttacaattttgtaaataccatgcctgtatttgcactagaaggctatgaaccattattattatcaatttatgccaaagctgcatttttgcatttaacattattacgagaaggtattcattatgctaatgattgggaactagatccaatacttataaatgatctatataaaaaagaattaacagaattcatcgctaaatatattaatcattgtgaaaaacattatgatataggattaaaaaatttatataataatcctaatgttccatgggatgtatacaatcattatcgtagagaattaactttaagtgtgttaaatataattgccttatttccacagtttgatttaaattattttcctaatactattctaaatacaggagaaataaagggtgttaatcctcaaatcactcaaaaactatatgtatccacaccaaacttgctcccaaatcaaaacggagatcgctcggtagaaaaagtcgaaaatctaattatacccccattaactctatttaattggctagaacaattagacatttacacagacaacacaactcgaaataaccctttttttaatggtgttcaaaatgcatatacatttacaggcgatataaattcttttcattggggtccaagatttggaataggaaacgagaatagagttggtataagttcaaatgtagatgaatttcttatttctatcaaattccaacaaatggttgaattacaatcaaataacactccatatttagggatcccttatatacaatttcatagtgataaaaatttagcgtacactgttggtagttcaagttgttatgatcaaacaaattgtatgccgagaataaattatacattacccaatgaaacacaaactgccacgaactatgactatatattatctgatgttacaatggtcgattctaaaaatctaccacttgctggctggtctcctgctcctagcatattatatttattcgcatttacacataaaagtgcaaaccttgaaaatacaatacaatcaatgagtaaaaacaacgttccaacaattacacaaatccctgtattcaaagctttcaaatttagcaatttaaacgataataataaatcagtaaaaatcagaaaacaatctggccatacaggaggaaatttaattgaattcgatacctttggagatgaaatccaaattaaatttaatattcttccaacaaattcaatcagaaattacaaattaagaattcgttatgcagcctctaattatttcggagaaggactaaaaataaatatacctactttaaataattttagttcaaacgtcaatattcaaaacactggtttaaatccaaacattaatataataccttatgaacaatttatatatactaacgaaataacaattccaaacatacccataagcgaacggaataataccatatttttagaaaaccgaagagtgggagtgggaacaactattattgataaaatagaatttattcctatg

SEQ ID NO: 250 - protein, 682 aa, Bacillus thuringiensis
MNPYNNDLYKIFDPNTSSYNFSQYTNNSRYPYTYDPKQIQQIINYQQTIQPDLTYSKYLENPKAFTTDWSTIASTSIIIIGTLIALSGPLALPGAILISVGTALPLLWPNPQENQTWRDFLQQGNSLLPGKELHQSTQDLIIGMLNGLQSGIDYYLSALNTWKQNPSNHQLTEEVINRFNIARYNFVNTMPVFALEGYEPLLLSIYAKAAFLHLTLLREGIHYANDWELDPILINDLYKKELTEFIAKYINHCEKHYDIGLKNLYNNPNVPWDVYNHYRRELTLSVLNIIALFPQFDLNYFPNTILNTGEIKGVNPQITQKLYVSTPNLLPNQNGDRSVEKVENLIIPPLTLFNWLEQLDIYTDNTTRNNPFFNGVQNAYTFTGDINSFHWGPRFGIGNENRVGISSNVDEFLISIKFQQMVELQSNNTPYLGIPYIQFHSDKNLAYTVGSSSCYDQTNCMPRINYTLPNETQTATNYDYILSDVTMVDSKNLPLAGWSPAPSILYLFAFTHKSANLENTIQSMSKNNVPTITQIPVFKAFKFSNLNDNNKSVKIRKQSGHTGGNLIEFDTFGDEIQIKFNILPTNSIRNYKLRIRYAASNYFGEGLKINIPTLNNFSSNVNIQNTGLNPNINIIPYEQFIYTNEITIPNIPISERNNTIFLENRRVGVGTTIIDKIEFIPM

SEQ ID NO: 251 - DNA, 2013 bp, Bacillus thuringiensis
atgaaccaaaattataacaacaatgagtatgaaattttagatcatggtaataggagctatcagactaagtatccctttgcacaagcaccaggttctgaatgccaaaagccgaatgccaaagatgggatatacacacctgtaggtagggtggatacagtcctccaaactatagatatagggttatctgttcgtacagcgatttctatcttacaaatgcttctgtctgtaagttttccagcactaggaagagctgctggactaataaatattatttttggatttctgtggggaacacttggtggtcaatctgtttgggaaagttttatgaaagcggtagagtctcttgtaaatcaaaaaattacagatgctgtcagagcaaaagccatttcagaattagaaggtgtacaaaacgctttagagttatatcaagaagcagcagatgattggaatgcaaatccagatgatgcatctaataaagagcgtgttagaagacagtttacatctacgaatacaataatcgagtatgctatgccatcatttcgagttccaacttttgaagtaccgttgttaactgtgtatgcgcaagcggctaatttacatttacaattattacgagatgccgttaagtttggaaacgaatggggtatgccatctgaggaagtagaggatctatatactagattaacaaggcgtacggcagagtatacagatcattgtgtgactgcctatgataaaggtttaaagggtgcttacgacttagcaccgaatccaacagattacaacaaatacccttatttaaatccatattcgaaagatccaatttacggtaaatactatactgcacccgttgattggaatctatttaatgactttcggagagacatgacaattatggtactagacattgtagcagtatggccaacctataatccgagaatctatacaaatccaaatggcgtacaagtagaattatcaagagaagtatatagcacggtgtatggaagaggcggtagtggtaattcatctgtggaggcaattgaatctcaaattgtcagaccacctcatttagtgacagaactaaccacccttaaaatcgagcaaggtggtactttagatatggaacagatacaatatcctaagtatatgaaggttacgaatacgcttcattatattggaagttctagcacatgggagcaaagctcttccgctattcctattagaccaattacaaagattcatactatcccagccaataatatcgggaacctttcattatctcaattagaagtaccttaccgattttctttctataacaaagatgatgctttaatttctgaaattggagctgaattccctccaaacaatgtaacctggaacggaatacctagagctgaagatagtgatcaaaatagtcatcatttatcttatgttggtgcgttaagtacacaatcttcagctgggtttccttggacatatccgacggagcttttgggagaatggggatttggctgggtgtctaacagtttaacacccgaaaataaaatagtaaatgataaaattacccaaattccagcggtgaagggatatttgttagaactaggggggatagttataaaaggacctggaagtacaggaggagatttagtacaactatcttctaatcagtcacaggtaaaactaaacatgatttcaccactatttacccctgagctcaccggacattatataagaattcgttatgcaagcagtgcggacactcgattatatataagctgggggagcaggacaggatattatgatgcgaaagctacctattcagaggggccattgacatataaaacctttggatatatgaatgcgggatggctgtatatgacgggggcaggtggaaataacttcactgcagtaattaaaaatcagggagatactcccattattattgacaaaatcgagttcattccatttacaggcttatacctagaggatcaagctttagaaaaggcaagaacggca

SEQ ID NO: 252 - protein, 671 aa, Bacillus thuringiensis
MNQNYNNNEYEILDHGNRSYQTKYPFAQAPGSECQKPNAKDGIYTPVGRVDTVLQTIDIGLSVRTAISILQMLLSVSFPALGRAAGLINIIFGFLWGTLGGQSVWESFMKAVESLVNQKITDAVRAKAISELEGVQNALELYQEAADDWNANPDDASNKERVRRQFTSTNTIIEYAMPSFRVPTFEVPLLTVYAQAANLHLQLLRDAVKFGNEWGMPSEEVEDLYTRLTRRTAEYTDHCVTAYDKGLKGAYDLAPNPTDYNKYPYLNPYSKDPIYGKYYTAPVDWNLFNDFRRDMTIMVLDIVAVWPTYNPRIYTNPNGVQVELSREVYSTVYGRGGSGNSSVEAIESQIVRPPHLVTELTTLKIEQGGTLDMEQIQYPKYMKVTNTLHYIGSSSTWEQSSSAIPIRPITKIHTIPANNIGNLSLSQLEVPYRFSFYNKDDALISEIGAEFPPNNVTWNGIPRAEDSDQNSHHLSYVGALSTQSSAGFPWTYPTELLGEWGFGWVSNSLTPENKIVNDKITQIPAVKGYLLELGGIVIKGPGSTGGDLVQLSSNQSQVKLNMISPLFTPELTGHYIRIRYASSADTRLYISWGSRTGYYDAKATYSEGPLTYKTFGYMNAGWLYMTGAGGNNFTAVIKNQGDTPIIIDKIEFIPFTGLYLEDQALEKARTA

SEQ ID NO: 253 - DNA, 1983 bp, Bacillus thuringiensis
atgaattcaaataatcttaatgaatatgaaattattgattcaaataattctgcttatctatctaacagaaataatacgtacgatagatatccttatgcgaataattcaaaccaacaattacaaaatatgaattataaagattgggtaaaggattgtcaaagtaatcaacaatatagcgaaaatccggaaaatttcgctgaccctaatacaattgcagcaatcagcgcaggtactattgttgtaggtacaatgctatctatttttgctgttgttcctcctttacttccagctggtattatagcttttggaactttattaccacttttgtttctttcaggagatgaaacaaaagtttggaaaggttttttacaaattggaacaagagcctataataaagatatagatgaagcagtatttactacaataagtagattagcacttgctgcaaaagaccatattgataattttgaaaaacagtttaatcaatggaaggctaatcgtacacaagccactgcaaaagaagtacagctatattttgctacaacaaattcagccttaataggttatttaggcgaattaagagagcaaacttatgaaatatccgcactccctatttatgcaaatttatctttactacacataaatttattaaaacatgctgctctgtactatgatgattggcttaaagatcaagggatatctcaaaatcctagttcttcatctgatatgtatgtatcaactttaaatactgcaatacaaaattataccaaccattgtacaaatatatataataaaggtctaaatatgcttaaaaatattccacacataaattggagtatttttaacacatatcgtagagacatgactataactgtacttgatattattgcactttttcctacttataatccgaaaaattttaagatggggggagttcactctgaacttactagaaaaatatatacatcatcatggcaactagaagaagaaaatttagataatgatattcatacattagaaaatcaacttacccgtccccctacactatttacttggttaaaaaatttagacctttatacaatgaacgcatcagactggcaaacttatttaacactaggtggtattcagaacaaatattcttataccaatgatgaaactaaatttagtactaacctacaaggattttatgttccaccagttaaaccaattgaaacggaaaattcacttatttataaattacaaatgcaacactattataatcctggttcaacttcaaacccagtaagtggaatttctaaaattattttttatagaaagaagttaaacggtgaggataaacctgaagaaatttatgattcaggcaataaaaatgaaaatgtaaaggaattcattatgagtggtcccaaagatagtataactaataattcagactctgcacatatattatcttctattaaattaacaaataataaaacaggaatactacgtaattttggatattcatttgaatggacacatattagtgttgattatcataatacaattttccaagataagatcactcaaattccagctgtcaaagcttattttattactgcagattcaaaagtcgtttctggccctggtcatacaggtggagacctaattactttaaaaaggtttatagattttggaatttcatcacttactaaaggttcttatgatatacggattcgatatgcagctaacaaggaaagttcattagttatatcattccaaggaagcgatgcatttgtaattatagataagacgacagatgttcgaaatagtagtgatctacagtatcaacattttcaatatgttacatttaagaaggcatttctgataagcacaataggagtaccattattattaagattacagggtatacctaatgatccagataacgtctggatagataaaattgaatttattccaataactccacaatacttagaaataagt

SEQ ID NO: 254 - protein, 661 aa, Bacillus thuringiensis
MNSNNLNEYEIIDSNNSAYLSNRNNTYDRYPYANNSNQQLQNMNYKDWVKDCQSNQQYSENPENFADPNTIAAISAGTIVVGTMLSIFAVVPPLLPAGIIAFGTLLPLLFLSGDETKVWKGFLQIGTRAYNKDIDEAVFTTISRLALAAKDHIDNFEKQFNQWKANRTQATAKEVQLYFATTNSALIGYLGELREQTYEISALPIYANLSLLHINLLKHAALYYDDWLKDQGISQNPSSSSDMYVSTLNTAIQNYTNHCTNIYNKGLNMLKNIPHINWSIFNTYRRDMTITVLDIIALFPTYNPKNFKMGGVHSELTRKIYTSSWQLEEENLDNDIHTLENQLTRPPTLFTWLKNLDLYTMNASDWQTYLTLGGIQNKYSYTNDETKFSTNLQGFYVPPVKPIETENSLIYKLQMQHYYNPGSTSNPVSGISKIIFYRKKLNGEDKPEEIYDSGNKNENVKEFIMSGPKDSITNNSDSAHILSSIKLTNNKTGILRNFGYSFEWTHISVDYHNTIFQDKITQIPAVKAYFITADSKVVSGPGHTGGDLITLKRFIDFGISSLTKGSYDIRIRYAANKESSLVISFQGSDAFVIIDKTTDVRNSSDLQYQHFQYVTFKKAFLISTIGVPLLLRLQGIPNDPDNVWIDKIEFIPITPQYLEIS

SEQ ID NO: 255 - DNA, 1389 bp, Bacillus thuringiensis
atggatagaagtggatttaatgttaatcgaactgttgattatacaaatacaaattggatgggtcgtattcctgattctcgtaggatcagtgaattatcaattccaggaacacatggatccatggcacttcatggtggagttgctggaactataggagatatagctatcaatcaaacaatgaatctagaaactcaattaaactcaggtattcgatatattgatattcgctgtaggcatcatcataataatttggctatccatcatggccagatattccaacacgcattttttggttctcatgttttagaacccgtgataagctttttaaggcgaaatccccgtgaaacaattttaatgcgtgtaaaagaagaatacaatccaacaggtaatacaagaacttttagtgaaacttttgaatctttctggagtccaaatcaacgttatttttggactcctactagtagtaatccaacattgggagaagtccgcgggagaattattgtactacaagactttcctagttggcatagaatttttggtattcattggggacagttaaacatacaagatcggtggcatgtagcgggtaatttagacatatacaataaatggatagctgttaaaaaccatttttctaatgcaatgaataatagaaatcgaatatctgttaatcatttaagtggcactggtggtgccggtgcaccaaggccctggtttttagcaagtggctatagcgtacgaagtaactattcttttttattttcgcctataccttggtttcctttgaatcagtttcctgatttcccacgtcctagtgccacatcaggccctgtattttttggaggaatgaacgtccttgcaactagaagaattagagaccgtaggtttactcatacaggaatagttgctgctgatttccctggaagaggattaattgacagcacaattgcattaaacttccctgaagattttaggggtaattttaaaattataacaatgctcaacaacacaagtcttgtagatatgcgtttaggatctagcaatatagtacatgtatgggacgatgtgaatcagagaaatgcacaatgggattttgtatttgatcaacaaagaaatgcatatctaataagaaatttatttgatagcagattagttttatctatggatgctcctcgtatgaatcatgtatttgcttatccagttaatggagatgattctcagttttggattttagaacctaatcagggtggatatatatttagaagtcttagagatagaaatttagttttaactgttgaaggtaacaatcccaatccacgtcctgaaacaagaatattagtttctccttttaataatggaaccaatcaaagatttagattagcaagagta

SEQ ID NO: 256 - protein, 463 aa, Bacillus thuringiensis
MDRSGFNVNRTVDYTNTNWMGRIPDSRRISELSIPGTHGSMALHGGVAGTIGDIAINQTMNLETQLNSGIRYIDIRCRHHHNNLAIHHGQIFQHAFFGSHVLEPVISFLRRNPRETILMRVKEEYNPTGNTRTFSETFESFWSPNQRYFWTPTSSNPTLGEVRGRIIVLQDFPSWHRIFGIHWGQLNIQDRWHVAGNLDIYNKWIAVKNHFSNAMNNRNRISVNHLSGTGGAGAPRPWFLASGYSVRSNYSFLFSPIPWFPLNQFPDFPRPSATSGPVFFGGMNVLATRRIRDRRFTHTGIVAADFPGRGLIDSTIALNFPEDFRGNFKIITMLNNTSLVDMRLGSSNIVHVWDDVNQRNAQWDFVFDQQRNAYLIRNLFDSRLVLSMDAPRMNHVFAYPVNGDDSQFWILEPNQGGYIFRSLRDRNLVLTVEGNNPNPRPETRILVSPFNNGTNQRFRLARV

SEQ ID NO: 257 - DNA, 2187 bp, Bacillus thuringiensis
atgaatcgaaactatccgaataatgaatatgagattatgaataataatgagatccatcaaccaaggtatcctcttgcagaggcaccaggttctgaattacaacggatgaattacacagattggatgaagaggtgtgcaggaggagaaccagaagacttattttcaaattcaaatgctattaggaatgggattattatcggtacaagtattgtaacagcaattcttagtgtatcatccccattggcggcggcaacaacgggcataatcgccgtactccttccatacttatggccagaaacacctgcaactatccaagcgcaatttacatgggaccagctgatgagtgctgctggagaacttattgataatagaatttcagatctagtaagaaccaatgcgattaatactttacgaatattacaatcacgtataagagactatcaacaagcaatctgtaatttgaaagcggatccaaataatgaagcatacaaagcggacgtaagaagagaatttaatgatgctgaagaccaggcgaaatccgttattatcgaattacaatctaacggctatgaaatttcgttattagctagttatgcgcaagctgccaatttacacttacttttattacgagatgtcgtaaaatacggagaaagctgggggttttcattcactgaagtccaacaatattattcgaatactagtgcagtaggaaacccaggcatgctacagttattagcaacctatacggattattgtgtgaattggtacaacacaggtgtaaataatttaaaacaacaagctggcctcactattgctgattggaataaggtcaatgatttccgtagggacatgaccattatggtactagatattgtgtcattatggccaacttataatccaagaatctatgcacaacctacaaaatcacaacttacacgtagtgtgtatacacccatgtcggggcaagtttttcgttctattgaggcgattgataatgagataatgccccctccgtctctattttcatggctacgtgaagtaactttatttagaagagcatttcctgtgtctactaatgagtatgcgctatttacgcagtatgctggttataaaatgtcattccagaatactttaaatcctacgttacaggaaacaccaatatccggcgaaagaggggatgaggttaatagtgtaaggattggtgaggagcctaatttggaagtttataaaatgcaaaatattttattgggatcaggagctagcagagattttgaatcgccacaaacatttgattttcattttacgccatcaggaacagttgaacgagtgggaatcaattatgcaaatatacagggagagccaacaagtgctacaaatcaaggacttgcttgtaacaataacagtagtgaaccttgtgatccttgtacttctgtcactccttgttcagttggtcctatcaatactactattccttgtgatagccttacttattatagtcatcgattgtcaaggataggtggcgttatgggtgcaaatccccaaagtataataggacttacctacggctggacacatgtaagtgcagatagaaccaatacaatagaaactgaaaagattacccaaattccagcggtgaagggccgtaaattggagggagatgtaataaagggacctggttctacaggaggtgatttggtgaaactatatcctgtgtatggtcgtaatcaattgcagatatacttgaatattccggcaagaacgaacaatatatcaggctataagataagaattcgttatgcaagtaagcagtctacagatatcggcgtagagttggaaaggacgataaatccacaatggcgaagatctactattctagctacctattctggtgataatctaacatacaattcttttagttatcatgatgttttagaaatagactctcaagaaagtgcacaccttgctaatttacgaatccgcaaggtcactgactatagtgcaggtacagaaatcacccttgacaaaatcgaattcattccaatagaaggatccgtggaagaatataaagcggatcaggatttagaaaaggcaagaaatgcagtgaacgccttgtttacaggtgctgcgaaaaatgctctgaagttgaatgtgacggattatgctgtggaccaagctgctaaccttgta

SEQ ID NO: 258 - protein, 729 aa, Bacillus thuringiensis
MNRNYPNNEYEIMNNNEIHQPRYPLAEAPGSELQRMNYTDWMKRCAGGEPEDLFSNSNAIRNGIIIGTSIVTAILSVSSPLAAATTGIIAVLLPYLWPETPATIQAQFTWDQLMSAAGELIDNRISDLVRTNAINTLRILQSRIRDYQQAICNLKADPNNEAYKADVRREFNDAEDQAKSVIIELQSNGYEISLLASYAQAANLHLLLLRDVVKYGESWGFSFTEVQQYYSNTSAVGNPGMLQLLATYTDYCVNWYNTGVNNLKQQAGLTIADWNKVNDFRRDMTIMVLDIVSLWPTYNPRIYAQPTKSQLTRSVYTPMSGQVFRSIEAIDNEIMPPPSLFSWLREVTLFRRAFPVSTNEYALFTQYAGYKMSFQNTLNPTLQETPISGERGDEVNSVRIGEEPNLEVYKMQNILLGSGASRDFESPQTFDFHFTPSGTVERVGINYANIQGEPTSATNQGLACNNNSSEPCDPCTSVTPCSVGPINTTIPCDSLTYYSHRLSRIGGVMGANPQSIIGLTYGWTHVSADRTNTIETEKITQIPAVKGRKLEGDVIKGPGSTGGDLVKLYPVYGRNQLQIYLNIPARTNNISGYKIRIRYASKQSTDIGVELERTINPQWRRSTILATYSGDNLTYNSFSYHDVLEIDSQESAHLANLRIRKVTDYSAGTEITLDKIEFIPIEGSVEEYKADQDLEKARNAVNALFTGAAKNALKLNVTDYAVDQAANLV

SEQ ID NO: 259 - DNA, 1137 bp, Bacillus thuringiensis
atgttacggaaaatgctaattgcgtgtatggcatgtttgttcggtctgcaaacaggagtcatacaggcagaggaaaagaatgaatccagacaagaaacgacttctacaactgaagaggaaacgactaaagatagatctgaagcatcagaagcaaagaatgactctactgaaaataggtctgaagattcagaacaaaataaagagaagaatattgaagaacaaaaacaaaacgatgttgaaaaaaatcaaaatagcccaataaaggatattgcaggtcatgcggctgaaaaagagattatatctctattcgataacaagatcatatcttctacagatgggctttttcgtccagatgaagagattaccatggctgaatttatcgtcctgctattgaagagtaaacaaattgaaccttctactgatggaaaaagtagcttcagtgatgtacccttgcaaaactgggtggctccctatgcagaaacagcatttcgtctaggtatcattcaaggaactgtagagaatggcaaacgaacacttaatccgaatggcttggtagaaaggcaggagttgattgccattctaaatagagcaagtggtaaaagtggagaagtaaataatgtgaaatggtcaacaacctatcatacattaaaaaactatcccgacagtcaagatgttcctacgtggagccaaagggaatatgcgtatgccttgcaaaatgaagaaactcagaaagctttaaatggaaagctggagcctgaaaaaaaggtaactcgggcagagacggctagtcaggtttactactcattatttttgcctgataaacaagaggcctcatctaaaaatacgactcctgtggagtttccgtataaacgcgttctacaggtaaaaacaacggcctatgacttcacgaatggacccacgaagggataccttggttgggacttacgagaggggattgtagctgttgatccttctgtaataccgcttggaacccatttatatatcgagggctacgggtatgctgtagccgctgacataggctcgaaagtaaaaaagaatcatattgatttgttcatgatctccccaaaacaggcgagggatcacggtattaagcaagcaaaggtgtatatcttgaat

SEQ ID NO: 260 - protein, 379 aa, Bacillus thuringiensis
MLRKMLIACMACLFGLQTGVIQAEEKNESRQETTSTTEEETTKDRSEASEAKNDSTENRSEDSEQNKEKNIEEQKQNDVEKNQNSPIKDIAGHAAEKEIISLFDNKIISSTDGLFRPDEEITMAEFIVLLLKSKQIEPSTDGKSSFSDVPLQNWVAPYAETAFRLGIIQGTVENGKRTLNPNGLVERQELIAILNRASGKSGEVNNVKWSTTYHTLKNYPDSQDVPTWSQREYAYALQNEETQKALNGKLEPEKKVTRAETASQVYYSLFLPDKQEASSKNTTPVEFPYKRVLQVKTTAYDFTNGPTKGYLGWDLREGIVAVDPSVIPLGTHLYIEGYGYAVAADIGSKVKKNHIDLFMISPKQARDHGIKQAKVYILN

SEQ ID NO: 261 - DNA, 1197 bp, Bacillus thuringiensis
atgaaatcattatcaaaaaaagtcgtggcaggattacttgtaggagcaacgagtctatctatctgggctcctgcaagcgaagcagcaactctaaaaaataataaatattacactattaattcgaaagttgatacaaaattagcttgggctccatatagctcatcttttgattcagtcatggaggtgctaccagtaaacaatcaggacgaacaaaaatatctatttttccaacttgatggaggttcgtatgcgattgtaaataaaagtagtggaaaagtttcatcatatgatcccaatatcgctataactacattatcatctacgagttggaagggttcccctagtcaacaatggcatttacgagatcagggaaatggttattatgaaattatgaatcaaggaaatgggaaagtcgcaacaactagattgaagtcctcatggggatcaccaaatttgaatattgatctcgataattcaaatccttctgatccagagaaattatttttaattgaagacattgatgttaatgcagtttttgggagtataactggtattccactaccggggggcgttcacctagttgatccaaacgctttttcagtacaaaatttaccgaatataggaactaggccaaatgccccagattatgattataatggaggtgttgatcaacaattacctcaaacttcaaattctgttgttgttggcgcatctttaataccttgtattatggtacaggataattcagcggatgattatacaaaaatacacaattcaccatattatactttggtaaaagaagaatattgggataaaacattttcagcggttgttccagctggtttaactcgtaattatagttttaaaacaggtatgacttctgtagatcaacaaaagatgactgatacgctttctatgaagattggagcagattttggattgaaatttggagacttaactgcaggacttaaaaccgaaatttcaagaacaatacaaacagaaattagtacaactaacacggaattatcggaagaacaaattacaagtaacattgtaagtgaagctggtaaaacaacaggatttacagaatatcaactggcaacaaaatatacgttaaagagagcagatggttcaattgtttcagatccttgggttgtaaaaaacaataagataacaatagctagaaaaaatgcaaaa

SEQ ID NO: 262 - protein, 399 aa, Bacillus thuringiensis
MKSLSKKVVAGLLVGATSLSIWAPASEAATLKNNKYYTINSKVDTKLAWAPYSSSFDSVMEVLPVNNQDEQKYLFFQLDGGSYAIVNKSSGKVSSYDPNIAITTLSSTSWKGSPSQQWHLRDQGNGYYEIMNQGNGKVATTRLKSSWGSPNLNIDLDNSNPSDPEKLFLIEDIDVNAVFGSITGIPLPGGVHLVDPNAFSVQNLPNIGTRPNAPDYDYNGGVDQQLPQTSNSVVVGASLIPCIMVQDNSADDYTKIHNSPYYTLVKEEYWDKTFSAVVPAGLTRNYSFKTGMTSVDQQKMTDTLSMKIGADFGLKFGDLTAGLKTEISRTIQTEISTTNTELSEEQITSNIVSEAGKTTGFTEYQLATKYTLKRADGSIVSDPWVVKNNKITIARKNAK

SEQ ID NO: 263 - DNA, 1887 bp, Bacillus thuringiensis
atggatcaaatttatcaaccttgttcttttccatataatgtattagcacaacctattaatttaacagactctgctgcattttattctcctactattttaggtacagatgatgctactattttggataaaattttagaggatattaaaaaatattatacaaaaggaacatttgcttctgattttgctaaaacaattcttcctcttattacacaacataaaattaattggagctctatcttaagtattgctttttcttttacaagttccattccttttttaggtacagcagtatccattctatctccttttttacaaatgttattcccatcagatcctgctgctcaaagtagaaaaataatggaagatattttggctcaaacacaaattatgattaatcaacaaattggatctgccgaattagatcgtattacacaaaatattgttggattaggtaatgtactatctcatcataatcaaacaattggtcaaattgcaaatcttgatccggccaaagtatttaatgcaattgaaactattgcagacatttttataactactgttccacagttagtttctcttggttatattcctcaaactttaccactgtatgtacaaggtattaatttatattttatgtttttaaaaacaacaatcgatagtgctaatctaattaaattaacagatggtgaaaccaatttttttaaaatagttttaaaggaagcaatacctcattatacaaatgaagtcatacaatattttaatagaattcctgatgcatctaaaacaactgaaattcgcaatgcaatgcagattaactgttttgattttgttgcattatggcctcttttagatcctgataattatcctactcaaacagatattgaacaaacacgtttattatttgaaaaaagtggatatggtgaatttgatggaggacgtgttccaactccgtatgatgattcagtaggttatcgttctgatttagaattaacgaatattgtaacaagaggtgcagatcgggttgatttcgtacaagaacaatttgcaaatggaacaactatcactgggggaagtggaccaggatatcaattccctgattttccttcttctcgaaataatcccgttacagatatttatgaatctagcacaaatggtgagcaataccaagctattcactataaagctgcagatggaacacttggaccttatcgacaaacaacatatgatcttactccaccacctggtcaaaaaatccattacactgcattaggtacacataattttatgggtgttgggcaagttggaccaatcttatccatgtttattcctatcaatttatttccagaaaatatcattggtgtaacagattcagaaacaggtaacattcccattaaaggtattccttttgaaaaaggacatacagaaggacttcgccatacaagagaagaagtgaatgctgcttccgctgttgtattagaacctggacaatccattatacttcctattacctgtgttacagcaagtatatatcaattacgaatcagatatgcatatactgaaaattcaggaagagctatacctataacaatatctacaagcaatggcagtttaaatagaacaaaacttctagaaaatacagcaggtaatccatatggagttattggaaataatggaacatatgtaattgaatatgatccttcaagtatatatattcctataggtaactttacagttaaaatttttaataatggaagaaatgaattatttttagatcgtttagagtttatccctataaaatcatcgtcctctccatcttctatgtttaatcaagattttcaagatttatccccaggtacttcaaaaattttatggtctggttctatagca

SEQ ID NO: 264 - protein, 629 aa, Bacillus thuringiensis
MDQIYQPCSFPYNVLAQPINLTDSAAFYSPTILGTDDATILDKILEDIKKYYTKGTFASDFAKTILPLITQHKINWSSILSIAFSFTSSIPFLGTAVSILSPFLQMLFPSDPAAQSRKIMEDILAQTQIMINQQIGSAELDRITQNIVGLGNVLSHHNQTIGQIANLDPAKVFNAIETIADIFITTVPQLVSLGYIPQTLPLYVQGINLYFMFLKTTIDSANLIKLTDGETNFFKIVLKEAIPHYTNEVIQYFNRIPDASKTTEIRNAMQINCFDFVALWPLLDPDNYPTQTDIEQTRLLFEKSGYGEFDGGRVPTPYDDSVGYRSDLELTNIVTRGADRVDFVQEQFANGTTITGGSGPGYQFPDFPSSRNNPVTDIYESSTNGEQYQAIHYKAADGTLGPYRQTTYDLTPPPGQKIHYTALGTHNFMGVGQVGPILSMFIPINLFPENIIGVTDSETGNIPIKGIPFEKGHTEGLRHTREEVNAASAVVLEPGQSIILPITCVTASIYQLRIRYAYTENSGRAIPITISTSNGSLNRTKLLENTAGNPYGVIGNNGTYVIEYDPSSIYIPIGNFTVKIFNNGRNELFLDRLEFIPIKSSSSPSSMFNQDFQDLSPGTSKILWSGSIA

SEQ ID NO: 265 - DNA, 906 bp, Bacillus thuringiensis
atggctatttttgattacaacgccaaagtagtagagtttagtcagtggtacgcttcaaggtatggttatacaaatctaagaaatttcaaatattattataatattacagatatcaatgctgttccagaatcaagtaatcccagtgtcactgtgactcctgttttagcaagaacatctattcaagaattgacaaataatacaagtgtaccacagacacaaacagtcagtttttcggaaactacaacagaaagtcagtcttctactacaacaaatggggcgaagttttctacaacagttacttctaccactaaatttacagctagcgtcaatttcaaagcgattggctcttccgttgatcaaaccattgctgtcgccatgacaggcgagtataattatagctcttcacaaacaaaaacgacaacaagtagtagaacgtggaccattacacagccagtaagtgtaccaccacgttcacgtgtaacttgtactttattgatttatgatgctccatttgcaatacctgtaaacttaaattgtaatatagtgggtactcaaccttttatcacctctacacagttagtgggatctacccatgatttctctactccaacaggtaccgcgggcacgcctccgggaataatgtatcttaataattggccaggtagaccgtctgaatatattggttctggtcgttcatcgggttcttcaagtgaaaatatacttaaatttcgaggaaaaggttcgcaaacagctgtacagggattatactcaacagttagatttgacgaaaccccattgccaggaaatcaaggggaaacgagaacctattactctccaatacaacttgcaaatcaggataatatcattcctacaaattctacttctattccaattatcaatccagtt

SEQ ID NO: 266 - protein, 302 aa, Bacillus thuringiensis
MAIFDYNAKVVEFSQWYASRYGYTNLRNFKYYYNITDINAVPESSNPSVTVTPVLARTSIQELTNNTSVPQTQTVSFSETTTESQSSTTTNGAKFSTTVTSTTKFTASVNFKAIGSSVDQTIAVAMTGEYNYSSSQTKTTTSSRTWTITQPVSVPPRSRVTCTLLIYDAPFAIPVNLNCNIVGTQPFITSTQLVGSTHDFSTPTGTAGTPPGIMYLNNWPGRPSEYIGSGRSSGSSSENILKFRGKGSQTAVQGLYSTVRFDETPLPGNQGETRTYYSPIQLANQDNIIPTNSTSIPIINPV

SEQ ID NO: 267 - DNA, 912 bp, Bacillus thuringiensis
atgtataatactactcaagtagcaaggggatttcaagctgatctggataatcaagcaatagaaacatttcagccaacaacaaatgttatccaagaatatcttacgtttgctgacttacaagcattaggttcaagtgtacaaagtgtacgttctagattttcagccatttatggtactactcccgatggcattgcattaaataatgaaacatattttaatgctgttcaaccacctattactgttcaatatggatattattgttacaaaaatgttggcactgttcaatatgtaaataagcctactgatatgaatccaaacgttattcttgctcaagatacattgacaaattctaccgatgaaccttttactacgactataactttaactggatcttggaccaaaacatctactgttacatctagtacaacagcgggtcttaaaattactactaaactctcaattaaaaaagtctttgaaattggtggagaagtttcattttctactaccgttggatcatctgaagccaactcagaaacatttactgtctctaaagctgttacggtcacagttccagctcaaagtagaaggaatattcaattaacagcgagagtagcaagagaatctgcagatttcagtgctcctattactgtcgatggttattttggtgctaacttccctcgtcgagtaggaccaggcggacattatttttggtttaacccagctagagacgttttaaatgctacctctggcgtactcagaggtacagttaataatgtatctagttacgattttcaaactgtagtgcaaccagcatttagcttattagctgaacagcatgaggctttagaagctgctatacccggcgatccttctgaagaacaattaacacaaatagaacaaatgactagaatg

SEQ ID NO: 268 - protein, 304 aa, Bacillus thuringiensis
MYNTTQVARGFQADLDNQAIETFQPTTNVIQEYLTFADLQALGSSVQSVRSRFSAIYGTTPDGIALNNETYFNAVQPPITVQYGYYCYKNVGTVQYVNKPTDMNPNVILAQDTLTNSTDEPFTTTITLTGSWTKTSTVTSSTTAGLKITTKLSIKKVFEIGGEVSFSTTVGSSEANSETFTVSKAVTVTVPAQSRRNIQLTARVARESADFSAPITVDGYFGANFPRRVGPGGHYFWFNPARDVLNATSGVLRGTVNNVSSYDFQTVVQPAFSLLAEQHEALEAAIPGDPSEEQLTQIEQMTRM

SEQ ID NO: 269 - DNA, 783 bp, Bacillus thuringiensis
atgcaaactcagctaatacgagagaaatttttattttcagatttacctgcaatgaattcaagttatgacaaagtgagagaagcattcaaagaaaaattcaaagtaaatccagatggtattgcagtaaatagcgaaacttattttaaaggagttacgcctgcaatcactgagcaatatggccacccttgctacaaaacacttggtgactttacgtatactaaaggagacggggcaccccctaaatctgtcatagtcggtagtaatattgctgtaaatcatggggatgaagcagccactatgactttagaagttcaaggcagttggcaaagtcaacaaacatggtctacagaaagtacaacaggcttaactttcgcttctaaatttacaatagagggcttttttgaatcagggatggaattctctgttagtactactataggggaatcaaaaactgaaacagaatcaaaaacggcaactgccaagatagaggtaacagtaccaccaagaagtaagaagaaggttgtaatagttgggacattaaaaaaagaaacgatgcattttcgtgcaccgatttttgtcaatggcatgtttggtgcaaacttccctaagagagtacaagatcattatttttggttccttaatgcgacaagtgtactcaaaaatacttctggagaaatatctggaacgattaaaaactctgccgtctttgatgttcatacggagattggtaaaacagagcctttaacagctgaagaattaagtgaatttatggcattaactaaa

SEQ ID NO: 270 - protein, 261 aa, Bacillus thuringiensis
MQTQLIREKFLFSDLPAMNSSYDKVREAFKEKFKVNPDGIAVNSETYFKGVTPAITEQYGHPCYKTLGDFTYTKGDGAPPKSVIVGSNIAVNHGDEAATMTLEVQGSWQSQQTWSTESTTGLTFASKFTIEGFFESGMEFSVSTTIGESKTETESKTATAKIEVTVPPRSKKKVVIVGTLKKETMHFRAPIFVNGMFGANFPKRVQDHYFWFLNATSVLKNTSGEISGTIKNSAVFDVHTEIGKTEPLTAEELSEFMALTK

That which is claimed:

1. A recombinant polynucleotide encoding an insecticidal polypeptide comprising an amino acid sequence having at least 93% sequence identity to SEQ ID NO: 122, wherein the polynucleotide is operably linked to a heterologous regulatory element.

2. The recombinant polynucleotide of claim 1, wherein the polynucleotide is SEQ ID NO: 121.

3. The recombinant polynucleotide of claim 1, wherein the polynucleotide is codon optimized for expression in an agricultural crop.

4. A DNA construct comprising the recombinant polynucleotide of claim 1.

5. A host cell comprising the recombinant polynucleotide of claim 1.

6. A host cell comprising the DNA construct of claim 4.

7. A transgenic plant comprising the polynucleotide of claim 1.

8. A transgenic plant comprising the DNA construct of claim 4.

9. A method of inhibiting growth or killing an insect pest or pest population, comprising contacting the insect pest with the insecticidal polypeptide of claim 1.

10. A method of inhibiting growth or killing an insect pest or pest population comprising expressing in a plant the polynucleotide of claim 1.

11. A method for controlling a pest infestation comprising providing in the diet of the pest the transgenic plant of claim 7 or a part thereof.

12. A method for improving the yield of a crop comprising growing the transgenic plant of claim 7, wherein the yield of the crop is increased in the presence of an insect pest relative to the crop not comprising said transgenic plant.

13. The method of claim 9, wherein the insect pest or pest population is resistant to at least one Cry insecticidal protein.

* * * * *